United States Patent 12,397,048 (BUNYAVIRALES VACCINE) - sequence listing, part 6

SEQ ID NO: 8372 - RNA, 3408 nt, synthetic construct
  misc_feature 1..3408: note = derived and/or modified CDS sequence (opt4) from DOBV(DOB/Saaremaa/160V)__AJ009774.2__GP
  source 1..3408: mol_type = other RNA
atgatcatgtggggcctgctgctgaccatgagcctgatcaacctgggcgccagcctgagaaacgtgtacgacatgaagatcgagtgcccccacagcatcaacttcggcgagagcagcgtgaccggcaaggtggagctgccccccatcctgctgaccgacgccgaggccctggtgcccgagagcagctgcaacatggacaaccaccagagcctgagcatcacccagaaggtgaccaaggtgagctggagaaagaaggccgaccaggtgcaggccgccaaggacagcttcgagaccaccagcaacgagatcaacctgaagggcacctgcaccctgacccacagaatggtggaggagagctacagaaacagaaagagcgtgatctgctacgacctgagctgcaacagcacccactgcaagcccaccatgcacatgatcgtgcccgtgcacagctgcaacatgatgaagagctgcctggtgggcctgggcccctacagagtgcaggtggtgtacgagagaacctactgcaccaccggcatcctgaccgagggcaagtgcttcgtgcccgaccagagcatcatcagcgtgatcaagaacggcgtgttcgacatcgccagcgtgagcatcgtgtgcttcttcatcagagtgaagggcaccagctacaagatcatggccagcatcaagaccagcaaccccaacaactgcaacgacaccgacaacaaggtgcagggctactacctgtgcatcgtgggcgccaacagcagccccgtgtacgcccccagcaccaccgacttcagaagcaccgaggccctggccagcctgctgagaagcccccacggcgaggaccacgacctgagcggcgaggaggtggccacctacagcatcgccggccagatcgagggcaagatcccccacaccgccaacgccgccaacatggccttcaccgccttcagcggcatccccagctacagcagcctgagcgtgttcgccggcaaccaggacggcaccatcatcttcagccccggcctgttccccaagctgaaccagagcagctgcgacaaggtggccctgcccctgatctgggagggctacatcgacctgcccggctactacgagaccatccacccctgcaacgtgttctgcgtgctgagcggccccggcgccagctgcgaggccttcagcgagggcggcatcttcaacatcaccagccccacctgcctggtgagcaagcagaacagattcagagccgccgagcagcagatcaacttcgtgtgccagagagtggaccaggacatcgtgatctactgcaacggccagaagaagaccatcctgaccaagaccctggtgatcggccagtgcatctacagcgtgaccagcctgttcagcatcatgcccagcgtggcccacagcatcgccatcgagctgtgcgtgcccggcttccacggctgggccaccgccgccctgctgaccaccttctgcttcggctggatcctgatccccagcatcaccctggccgtgctgatcgtgctgaagttcttcgccgccatcctgcacaacagcagccaggagaacagattcaagatcatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagctgaccgagagcgccttccaggcccactacagagtgtgccaggccacccacagattcagagacgacctgaagaagaccatcaccccccagagcaccagccccggctgctacagaaccctgaacctgttcagatacaagagcagatgctacatcttcaccgtgtgggtggtgctgctgatcatcgagagcatcctgtgggccgccagcgccagcgagctggtgctggagcccaactggaacgacaacgcccacggcgtgggcatcgtgcccatgcacaccgacctggagctggacttcagcctgcccagcagcagcaagtacacctacaagagaaagctgaccagccccatcaaccaggagcagagcatcgacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacaactggagctgcaacccccccgactgccccggcatcggcaccggctgcaccgcctgcggcctgtacctggaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccaccacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccaggccttcaacaccagctacatccactacaccgacgagcagatcgagtggaaggaccccgacggcatgctgaaggaccacctgaacatcctggtgaccaaggacatcgacttcgagaacctgggcgagaacccctgcagagtgggcctgcagaccgccagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctggtgagaggccagaacaccgtgaaggtgagcggcaagggcggccacagcggcagcagcttcaagtgctgccacggcaacgactgcagccagcagggcctgcaggccagcgccccccacctggacaaggtgaacggcatcgtggagcaggagagcacccaggtgtacgacgacggcgccccccagtgcggcatcagctgctggttcatcaagagcggcgagtggatcaagggcatcttcagcggcaactggatcgtgatcgtggtgctgatcgtgctgttcatcctgagcctgatcctgctgagcttcctgtgccccatcagaaagcacaagagaagctga

SEQ ID NO: 8373 - RNA, 3408 nt, synthetic construct
  misc_feature 1..3408: note = derived and/or modified CDS sequence (opt4) from DOBV(East Slovakia/400Af/98)__AY168577.1__GP
  source 1..3408: mol_type = other RNA
atgatcatgtggggcctgctgctgaccatgatcctgatcgacttcggcaccagcctgagaaacgtgtacgacatgaagatcgagtgcccccacagcatcaacttcggcgagagcagcgtgaccggcaaggtggagctgccccccctgctgctgaccgacgccgaggccctggtgcccgagagcagctgcaacatggacaaccaccagagcatgagcatcatccagaaggtgaccaaggtgagctggagaaagaaggccgacaaggcccaggccgccaaggacagcttcgagaccaccagcagcgaggtgaacctgaagggcacctgcaccctgagccacagaatggtggaggagagctacagaaacagaagaagcgtgatctgctacgacctgagctgcaacagcacccactgcaagcccaccatgcacatgatcgtgcccgtgcacagctgcaacatgatgaagagctgcctggtgggcctgggcccctacagaatccaggtggtgtacgagagaacctactgcaccaccggcatcctgaccgagggcaagtgcttcgtgcccgaccagagcatcgtgaacgtgatcaagaacggcgtgttcgacatcgccagcgtgagcatcgtgtgcttcttcatcagagtgaagggcaccaactacaagatcatggccagcatcaagaccgccaccgccaacaactgcaacgacaccgacaacaaggtgcagggctactacctgtgcatcgtgggcggcaacagcagccccgtgtacgcccccagcaccaccgacttcagaagcatggaggccctggccagcctgctgagagccccccacggcgaggaccacgacctgagcggcgaggaggtggccacctacagcatcgccggccagatcgagggcaagatcccccacaccgccaacgccgccaacatgctgttcaccgccttcagcggcatccccagctacagcagcctgagcgtgtacatcggcagccaggacggccccgtggtgtacagccccggcctgttccccaagctgaaccagagcagctgcgacaaggtggccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcaggtgaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatccccagcatcaccctggccgtgctggtggtgctgaagttcttcgccgccatcctgcacaacagcagccaggagaacagattcaagatcatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagcccaccgagagcgccttccaggcccactacaaggtgtgccaggccacccacagattcagagacgacctgaagaagaccatcaccccccagagcaccagccccggctgctacagaaccctgaacctgttcagatacaagagcagatgctacatcttcaccgtgtgggtgaccctgctgatcatcgagagcatcatgtgggccgccagcgccagcgagaacgtgctggagcccagctggaacgacaacgcccacggcgtgggcgtggtgcccatgcacaccgacctggagctggacttcagcctgcccagcagcagcaagtacacctacaagagaaagctgaccagccccctgaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacagctggggctgcaaccccgccgactgccccggcatcggcaccggctgcaccgcctgcggcctgtacatcgaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccagcacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccagagcttcaacaccagcagcatccactacaccgacgagagaatcgagtggaaggaccccgacggcatgctgaaggaccacctgaacatcctggtgaccaaggacatcgacttcgagaacctgggcgagaacccctgcaaggtgggcctgcagaccagcagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctgatcagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggagagcgagaaggtgtacgacgacggcgccccccagtgcggcatcagctgctggttcgtgaagagcggcgagtggatcaccggcatcttcaacggcaactggatcgtgatcgtggtgctgatcttcttcttcatcctgagcctgatcctgctgagcctgctgtgccccatcagaaagcacaagagaagctga

SEQ ID NO: 8374 - RNA, 3408 nt, synthetic construct
  misc_feature 1..3408: note = derived and/or modified CDS sequence (opt4) from DOBV(East Slovakia/862Aa/97)__AY168578.1__GP
  source 1..3408: mol_type = other RNA
atgatcatgtggggcctgctgctgaccatgagcctgatcaacctgggcgccagcctgagaaacgtgtacgacctgagaatcgagtgcccccacagcatcaacttcggcgagagcagcgtgaccggcaaggtggagctgccccccatccccctgaccgacgccgagaccctggtgcccgagagcagctgcaacatggacaaccaccagagcctgagcatcacccagaaggtgaccaaggtgagctggagaaagaaggccgacaaggtgcaggccgccaaggacagcttcgagaccaccagcagcgagatcaacctgaagggcacctgcaccctggcccacagaatggtggaggagagctacagaaacagaaagagcgtgatctgctacgacctgagctgcaacagcacccactgcaagcccaccatgtacatgatcgtgcccgtgcacagctgcaacatgatgaagagctgcctggtgggcctgggcccctacagaatccaggtggtgtacgagagaacctactgcaccaccggcatcctgatcgagggcaagtgcttcgtgcccgaccagagcatcatcagcgtgatcaagaacggcgtgttcgacatcgccagcgtgagcatcgtgtgcttcttcatcagaatcaagggcaacagctacaagatcatgaccaacatcaagaccgccaaccccaacaactgcaacgacaccgacaacaaggtgcagggctactacctgtgcatcgtgggcgccaacagcagccccgtgtacgcccccagcaccaccgacttcagaagcatggaggtgctggccagcctgctgagaagcccccacggcgaggaccacgacctgagcggcgaggaggtggccacctacagcatcgccggccaggtggagggcaaggtgccccacaccgagaacgccgccaacatgctgttcaccgccttcagcggcatccccagctacagcagcctgagcgtgttcgccggcaaccaggacggcaccgtgatctacagccccggcctgttccccaagctgaaccagagcagctgcgagaaggtggccctgcccctgatctgggagggctacatcgacctgcccggctactacgagaccatccacccctgcaacgtgttctgcgtgctgagcggccccggcgccagctgcgaggccttcagcgagggcggcatcttcaacatcaccagccccacctgcctggtgagcaagcagaacagattcagagccgccgagcagcagatcaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatccccagcatcaccctggccatcctgatcgtgctgaagttcttcgccgccatcctgcacaacagcagccaggagaacagattcaaggtgatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagctgaccgagagcgccttccaggcccactacagagtgtgccaggccacccacagattcagagacgacctgaagaagaccatcaccccccagagcaccagccccggctgctacagaaccctgaacctgttcagatacaagagcagatgctacatcttcaccgtgtgggtggtgctgctgatcatcgagagcatcctgtgggccgccagcgccagcgagatcgtgctggagcccagctggaacgacaacgcccacggcgtgggcgtggtgcccatgcacaccgacctggagctggacttcagcctgcccagcagcagcaagtacacctacaagagaaagctgaccagccccatcaaccaggagcagagcgtggacctgcacatcgagatcgagagccagagaatcagcaccagcgtgcacgccctgggccactggttcgacggcagactgaacctgaagaccagcttccactgctacggcgcctgcaccaagtacgagtacccctggcacaccgccagatgccacttcgagagagacttcgagtacgagaacagctggagctgcaaccccgccgactgccccggcatcggcaccggctgcaccgcctgcggcctgtacctggaccagctgaagcccgtgggcagcgcctacaagctgatcaccgtgagatacagcagaaaggtgtgcgtgcagttcggcgaggagaacctgtgcaagatcatcgacatgaacgactgcttcgtgagcagacacgtgaaggtgtgcatcatcggcaccgtgagcaagttcagccagggcgacaccctggtgttcctgggccccatggagggcggcggcctgatcttcaaggactggtgcaccaccacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccaggccttcaacaccagctacatccactacaccgacgagagaatcgagtggaaggaccccgacggcatgctgaaggaccacatcaacatcctggtgaccaaggacatcgacttcgagaacctgggcgagaacccctgcaaggtgggcctgcagaccgccagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctggtgagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggagagcacccaggtgtacgacgacggcgccccccagtgcggcatcagctgctggttcatcaagagcggcgagtggatcaagggcatcttcaacggcaactggatcgtgatcgtggtgctgatcttcttcttcatcctgagcctgatcctgctgagcttcctgtgccccatcagaaagcacaagagaagctga

SEQ ID NO: 8375 - RNA, 3408 nt, synthetic construct
  misc_feature 1..3408: note = derived and/or modified CDS sequence (opt4) from DOBV(A35)__GU904036.1__GP
  source 1..3408: mol_type = other RNA
atgatcatgtggggcctgctgctgaccctgagcctgatcagcctgggcgccagcctgagaaacgtgtacgacctgagaatcgagtgcccccacagcatcaacttcggcgagagcagcgtgaccggcaaggtggagctgccccccatccccctgaccgacgccgagaccctggtgcccgagagcagctgcaacatggacaaccaccagagcctgagcatcacccagaaggtgaccaaggtgagctggagaaagaaggccgacaaggtgcaggccgccaaggacagcttcgagaccaccagcagcgagatcaacctgaagggcacctgcaccctggcccacagaatggtggaggagagctacagaagcagaaagagcgtgatctgctacgacctgagctgcaacagcacccactgcaagcccaccatgtacatgatcgtgcccgtgcacagctgcaacatgatgaagagctgcctggtgggcctgggcccctacagaatccaggtggtgtacgagagaacctactgcaccaccggcatcctgatcgagggcaagtgcttcgtgcccgaccagagcatcatcagcgtgatcaagaacggcgtgttcgacatcgccagcgtgagcatcgtgtgcttcttcatcagaatcaagggcaacagctacaagatcatgaccaacatcaagaccgccaaccccaacaactgcaacgacaccgacaacaaggtgcagggctactacctgtgcatcgtgggcgccaacagcagccccgtgtacgcccccagcaccaccgacttcagaagcatggaggtgctggccagcctgctgagaagcccccacggcgaggaccacgacctgagcggcgaggaggtggccacctacagcatcgccggccaggtggagggcaaggtgccccacaccgagaacgccgccaacatgctgttcaccgccttcagcggcatccccagctacagcagcctgagcgtgttcgccggcaaccaggacggcaccgtgatctacagccccggcctgttccccaagctgaaccagagcagctgcgagaaggtggccctgcccctgatctgggagggctacatcgacctgcccggctactacgagaccatccacccctgcaacgtgttctgcgtgctgagcggccccggcgccagctgcgaggccttcagcgagggcggcatcttcaacatcaccagccccacctgcctggtgagcaagcagaacagattcagagccgccgagcagcagatcaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatccccagcatcaccctggccatcctgatcgtgctgaagttcttcgccgccatcctgcacaacagcagccaggagaacagattcaaggtgatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagctgaccgagagcgccttccaggcccactacagagtgtgccaggccacccacagattcagagacgacctgaagaagaccatcaccccccagagcaccagccccggctgctacagaaccctgaacctgttcagatacaagagcagatgctacatcttcaccgtgtgggtggtgctgctgatcatcgagagcatcctgtgggccgccagcgccagcgagatcgtgctggagcccagctggaacgacaacgcccacggcgtgggcgtggtgcccatgcacaccgacctggagctggacttcagcctgcccagcagcagcaagtacacctacaagagaaagctgaccagccccatcaaccaggagcagagcgtggacctgcacatcgagatcgagagccagagaatcagcaccagcgtgcacgccctgggccactggttcgacggcagactgaacctgaagaccagcttccactgctacggcgcctgcaccaagtacgagtacccctggcacaccgccagatgccacttcgagagagacttcgagtacgagaacagctggagctgcaaccccgccgactgccccggcatcggcaccggctgcaccgcctgcggcctgtacctggaccagctgaagcccgtgggcagcgcctacaagctgatcaccgtgagatacagcagaaaggtgtgcgtgcagttcggcgaggagaacctgtgcaagatcatcgacatgaacgactgcttcgtgagcagacacgtgaaggtgtgcatcatcggcaccgtgagcaagttcagccagggcgacaccctggtgttcctgggccccatggagggcggcggcctgatcttcaaggactggtgcaccaccacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccaggccttcaacaccagctacatccactacaccgacgagagaatcgagtggaaggaccccgacggcatgctgaaggaccacatcaacatcctggtgaccaaggacatcgacttcgagaacctgggcgagaacccctgcaaggtgggcctgcagaccgccagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctggtgagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggagagcacccaggtgtacgacgacggcgccccccagtgcggcatcagctgctggttcatcaagagcggcgagtggatcaagggcatcttcaacggcaactggatcgtgatcgtggtgctgatcttcttcttcatcctgagcctgatcctgctgagcttcctgtgccccatcagaaagcacaagagaagctga

SEQ ID NO: 8376 - RNA, 3408 nt, synthetic construct
  misc_feature 1..3408: note = derived and/or modified CDS sequence (opt4) from DOBV(A6)__GU904033.1__GP
  source 1..3408: mol_type = other RNA
atgatcatgtggggcctgctgctgaccatgatcctgatcgacttcggcgccagcctgagaaacgtgtacgacatgaagatcgagtgcccccacagcatcaacttcggcgagagcagcgtgaccggcaaggtggagctgccccccctgctgctgaccgacgccgaggccctggtgcccgagagcagctgcaacatggacaaccaccagagcatgagcatcatccagaaggtgaccaaggtgagctggagaaagaaggccgacaaggcccaggccgccaaggacagcttcgagaccaccagcagcgaggtgaacctgaagggcacctgcaccctgagccacagaatggtggaggagagctacagaaacagaagaagcgtgatctgctacgacctgagctgcaacagcacccactgcaagcccaccatgcacatgatcgtgcccgtgcacagctgcaacatgatgaagagctgcctggtgggcctgggcccctacagaatccaggtggcctacgagagaacctactgcaccaccggcatcctgaccgagggcaagtgcttcgtgcccgaccagagcatcgtgagcgtgatcaagaacggcgtgttcgacatcgccagcgtgagcatcgtgtgcttcttcatcagagtgaagggcaccaactacaagatcatggccagcatcaagaccgccaccgccaacaactgcaacgacaccgacaacaaggtgcagggctactacctgtgcatcgtgggcggcaacagcagccccgtgtacgcccccagcaccaccgacttcagaagcatggaggccctggccagcctgctgagagccccccacggcgaggaccacgacctgagcggcgaggaggtggccacctacagcatcgccggccagatcgagggcaagatcccccacaccgccaacgccgccaacatgctgttcaccgccttcagcggcatccccagctacagcagcctgagcgtgttcatcggcagccaggacggccccatcatctacagccccggcctgttccccaagctgaaccagagcagctgcgacaaggtggccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcaggtgaacttcgtgtgccagagagtggaccaggacatcatcatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatccccagcatcaccctggccgtgctggtggtgctgaagttcttcgccgccatcctgcacaacagcagccaggagaacagattcaagatcatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagcccaccgagagcgccttccaggcccactacaaggtgtgccaggccacccacagattcagagacgacctgaagaagaccatcaccccccagagcaccagccccggctgctacagaaccctgaacctgttcagatacaagagcagatgctacatcttcaccgtgtgggtgaccctgctgatcatcgagagcatcatgtgggccgccagcgccagcgagaacgtgctggagcccagctggaacgacaacgcccacggcgtgggcgtggtgcccatgcacaccgacctggagctggacttcagcctgcccagcagcagcaagtacacctacaagagaaagctgaccagccccctgaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacagctggggctgcaaccccgccgactgccccggcatcggcaccggctgcaccgcctgcggcctgtacatcgaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggtgggcggcggcctgatcttcaaggactggtgcaccagcacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccagagcttcaacaccagcagcatccactacaccgacgagagaatcgagtggaaggaccccgacggcatgctgaaggaccacctgaacatcctggtgaccaaggacatcgacttcgagaacctgggcgagaacccctgcaaggtgggcctgcagaccagcagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctgatcagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggacagcgagaaggtgtacgacgacggcgccccccagtgcggcatcagctgctggttcgtgaagagcggcgagtggatcaccggcatcttcaacggcaactggatcgtgatcgtggtgctggtgttcttcttcatcctgagcctgatcctgctgagcctgctgtgccccatcagaaagcacaagagaagctga

SEQ ID NO: 8377 - RNA, 3408 nt, synthetic construct
  misc_feature 1..3408: note = derived and/or modified CDS sequence (opt4) from DOBV(B13)__GU904034.1__GP
  source 1..3408: mol_type = other RNA
atgatcatgtggggcctgctgctgaccatgatcctgatcgacttcggcgccagcctgagaaacgtgtacgacatgaagatcgagtgcccccacagcatcaacttcggcgagagcagcgtgaccggcaaggtggagctgccccccctgctgctgaccgacgccgaggccctggtgcccgagagcagctgcaacatggacaaccaccagagcatgagcatcatccagaaggtgaccaaggtgagctggagaaagaaggccgacaaggcccaggccgccaaggacagcttcgagaccaccagcagcgaggtgaacctgaagggcacctgcaccctgagccacagaatggtggaggagagctacagaaacagaagaagcgtgatctgctacgacctgagctgcaacagcacccactgcaagcccaccatgcacatgatcgtgcccgtgcacagctgcaacatgatgaagagctgcctggtgggcctgggcccctacagaatccaggtggtgtacgagagaacctactgcaccaccggcatcctgaccgagggcaagtgcttcgtgcccgaccagagcatcgtgagcgtgatcaagaacggcgtgttcgacatcgccagcgtgagcatcgtgtgcttcttcatcagagtgaagggcaccaactacaagatcatggccagcatcaagaccgccaccgccaacaactgcaacgacaccgacaacaaggtgcagggctactacctgtgcatcgtgggcggcaacagcagccccgtgtacgcccccagcaccaccgacttcagaagcatggaggccctggccagcctgctgagagccccccacggcgaggaccacgacctgagcggcgaggaggtggccacctacagcatcgccggccagatcgagggcaagatcccccacaccgccaacgccgccaacatgctgttcaccgccttcagcggcatccccagctacagcagcctgagcgtgttcatcggcagccaggacggccccatcatctacagccccggcctgttccccaagctgaaccagagcagctgcgacaaggtggccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcaggtgaacttcgtgtgccagagagtggaccaggacatcatcatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatccccagcatcaccctggccgtgctggtggtgctgaagttcttcgccgccatcctgcacaacagcagccaggagaacagattcaagatcatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagcccaccgagagcgccttccaggcccactacaaggtgtgccaggccacccacagattcagagacgacctgaagaagaccatcaccccccagagcaccagccccggctgctacagaaccctgaacctgttcagatacaagagcagatgctacatcttcaccgtgtgggtgaccctgctgatcatcgagagcatcatgtgggccgccagcgccagcgagaacgtgctggagcccagctggaacgacaacgcccacggcgtgggcgtggtgcccatgcacaccgacctggagctggacttcagcctgcccagcagcagcaagtacacctacaagagaaagctgaccagccccctgaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacagctggggctgcaaccccgccgactgccccggcatcggcaccggctgcaccgcctgcggcctgtacatcgaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggtgggcggcggcctgatcttcaaggactggtgcaccagcacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccagagcttcaacaccagcagcatccactacaccgacgagagaatcgagtggaaggaccccgacggcatgctgaaggaccacctgaacatcctggtgaccaaggacatcgacttcgagaacctgggcgagaacccctgcaaggtgggcctgcagaccagcagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctgatcagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggacagcgagaaggtgtacgacgacggcgccccccagtgcggcatcagctgctggttcgtgaagagcggcgagtggatcaccggcatcttcaacggcaactggatcgtgatcgtggtgctggtgttcttcttcatcctgagcctgatcctgctgagcctgctgtgccccatcagaaagcacaagagaagctga

SEQ ID NO: 8378 - RNA, 3408 nt, synthetic construct
  misc_feature 1..3408: note = derived and/or modified CDS sequence (opt4) from DOBV(Aa1854/Lipetsk-02)__EU188453.1__GP
  source 1..3408: mol_type = other RNA
atgatcatgtggggcctgctgctgaccatggccctgatcaaccccggcgccaccctgagaaacgtgtacgacatgagaatcgagtgcccccacagcatcaacttcggcgagagcagcgtgaccggcaaggtggagctgccccccatccccctggccgacgccgagaccctggtgcccgagagcagctgcaacatggacaaccaccagagcctgagcatcacccagaaggtgaccaaggtgagctggagaaagaaggccgacaaggtgcaggccgccaaggacagcttcgagaccaccagcagcgagatcaacctgaagggcacctgcaccctgacccacagaatggtggaggagagctacagaaacagaaagagcgtgatctgctacgacctgagctgcaacagcacccactgcaagcccaccatgcacatgatcgtgcccgtgcacagctgcaacatgatgaagagctgcctggtgggcctgggcccctacagaatccaggtggtgtacgagagaacctactgcaccaccggcatcctgaccgagggcaagtgcttcgtgcccgaccagagcatcgtgagcgtgatcaagaacggcgtgttcgacatcgccagcgtgagcatcgtgtgcttcttcatcagaatcaagggcaacagctacaagatcatggccagcatcaaggaggccaaccccaacaactgcaacgacaccgacaacaaggtgcagggctactacctgtgcatcgtgggcgccaacagcagccccgtgtacgcccccagcaccaccgacttcagaagcgtggaggccctggccagcctgctgagaagcccccacggcgaggaccacgacctgagcggcgaggaggtggccacctacagcatcgccggccaggtggagggcaaggtgccccacaccgccaacgccgccaacatgctgttcaccgccttcagcggcatccccagccacagcagcttcagcgtgttcaccggcaaccaggacggcaccgtgatctacagccccggcctgttccccaagctgaaccagagcgcctgcgacaaggtggccctgcccctgatctgggagggctacatcgacctgcccggctactacgagaccatccacccctgcaacgtgttctgcgtgctgagcggccccggcgccagctgcgaggccttcagcgagggcggcatcttcaacatcaccagccccacctgcctggtgagcaagcagaacagattcagagccgccgagcagcagatcaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatccccagcatcaccctggccatcctgatcgtgctgaagttcttcgccgccatcctgcacaacagcagccaggagaacagattcaagatcatcctgagaaagatcaaggaggagttcgagagaaccaagggcagcatggtgtgcgaggtgtgcaagtacgagtgcgagaccggcaaggagctgaaggcccacaacctgagctgcccccagagccagtgcccctactgcttcacccactgcgagctgaccgagagcgccttccaggcccactacagagtgtgccaggccacccacagattcagagacgacctgaagaagaccatcaccccccagagcaccagccccggctgctacagaaccctgaacctgttcagatacaagagcagatgctacatcttcaccgtgtgggtggtgctgctgatcatcgagagcatcctgtgggccgccagcgccagcgagaccgtgctggagcccaactggaacgacaacgcccacggcgtgggcgtggtgcccatgcacaccgacctggagctggacttcagcctgcccagcagcagcaagtacacctacaagagaaagctgaccagccccatcaaccaggagcagagcgtggacctgcacatcgaggtggagagccagggcatcagcaccagcgtgcacgccctgggccactggttcgacggcagactgaacctgaagaccagcttccactgctacggcgcctgcaccaagtacgagtacccctggcacaccgccagatgccacttcgagagagacttcgagtacgagaacagctggagctgcaaccccgccgactgccccggcatcggcaccggctgcaccgcctgcggcctgtacctggaccagctgaagcccgtgggcagcgcctacaagctgatcaccgtgagatacagcagaagagtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccaccacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccaggccttcaacaccagcaacatccactacaccgacgagagaatcgagtggaaggaccccgacggcatgctgaaggaccacctgaacatcctggtgaccaaggacatcgacttcgagaacctgggcgagaacccctgcaaggtgggcctgcagaccgccagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctggtgagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggagagcacccaggtgtacgacgacggcgccccccagtgcggcatcagctgctggttcatcaagagcggcgagtggatcaagggcatcttcaacggcaactggatcgtgatcgtggtgctgatcttcttcttcatcctgagcctgatcctgctgagcttcctgtgccccatcagaaagcacaagagaagctga

SEQ ID NO: 8379 - RNA, 3402 nt, synthetic construct
  misc_feature 1..3402: note = derived and/or modified CDS sequence (opt4) from DOBV(Ap/Sochi/hu)__JF920149.1__GP
  source 1..3402: mol_type = other RNA
atgtggggcctgctgctgaccatgatcctgatcgacttcggcgccaccctgagaaacgtgtacgacatgagaatcgagtgcccccacagcgtgaacttcggcgagagcagcgtgagcggcaaggtggagctgccccccgtgctgctgagcgaggtggagaccctggtgcccgagagcagctgcaacatggacaaccaccagagcatgagcatcatccagaaggtgacccagctgacctggagaaagaaggccgacaaggcccaggccgccaaggacagcttcgagatcaccagcggcgaggtgagcctgaagggcacctgcaccctgacccacagaatggtggaggacagccacagaaacagaaagagcatcatctgctacgacctgagctgcaacagcacccactgcaagcccaccatgcacatgatcgtgcccatccacagctgcaacatgatgaagagctgcctggtgggcctgggcccctacagaatccaggtggtgtacgagagaacctactgcaccaccggcatcctgaccgagggcaagtgcttcgtgcccgaccagagcatcgtgaacgtgatcaagaacggcgtgttcgacatcgccagcgtgagcatcgtgtgcttcttcgtgagagtgaagggcaccaactacaagatcatggccagcatcaagaccgccaccagcaacaactgcaacgacaccggcaacaaggtgcagggctactacctgtgcatcgtgggcggcaacagcagccccgtgtacgtgcccagcaccaccgacttcagaagcatggaggccctggccagcatgctgagagccccccacggcgaggaccacgacctggccggcgaggaggtggccacctacagcatcgccggccaggtggagggcaaggtgccccacaccgccagcaccgccaacatgctgctgaccgccttcagcggcatccccagctacagcagcctgagcgtgttcaccggcagccaggacggccccatcgtgtacagccccggcctgttccccaagctgaaccagagcagctgcgacaaggtgggcctgcccctgatctgggagggctacatcgacctgcccggctactacgagaccgtgcaccagtgcaacgtgttctgcgtgctgagcggccccggcgccagctgcgaggccttcagcgagggcggcatcttcaacatcaccagccccaactgcatggtgagcaagcagaacagattcagagccgccgagcagcaggtgaacttcgcctgccagagagtggaccaggacatcctgatcttctgcaacggccagaagaagaccatcctgaccaagaccctggtgatcggccagtgcatctacagcatcaccagcctgttcagcatcatgcccggcgtggcccacagcatcgccatcgagctgtgcgtgcccggcttccacggctgggccaccgccgccctgctgaccaccttctgcttcggctgggtgctgatccccagcatcaccctggccgtgctggtggtgctgaagttcttcgccgccatcctgcacaacagcagccaggagaacagattcaagctgatcctgaagaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagcccaccgagagcgccttccaggcccactacaaggtgtgccaggccacccacagattcagagacgacctgaagaagaccatcaccccccagagcaccagccccggctgctacagaaccctgaacctgttcagatacaagagcagatgctacatcttcaccgtgtgggtggtgctgctggtggtggagagcgtgatgtgggccgccagcgccagcgagaccgtgctggagcccagctggaacgacaacgcccacggcgtgggcgtggtgcccatgcacaccgacctggagctggacttcagcctgcccagcagcagcaagtacacctacaagagaaagctgaccagccccatcaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccagatgccacttcgagagagacttcgagtacgagaacagctggggctgcaaccccgccgactgccccggcatcggcaccggctgcaccgcctgcggcatctacatcgaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccagcacctgccagttcggcgaccccggcgacatcatgagccccaaggacaagggcttcagctgccccgagttcaccggccacttcagaaagaagtgcaacttcgccaccacccccgtgtgcgagtacgacggcaacatggtgagcggctacaagaaggtgatggccaccatcgacagcttccaggccttcaacaccagcagcatccactacaccgacgagagaatcgagtggaaggaccccgacggcatgctgaaggaccacctgaacatcctggtgaccaaggacatcgacttcgagaacctgggcgacaacccctgcaaggtgggcctgcagaccgtgagcatcgagggcgcctggggcagcggcgtgggcttcaccctgacctgccaggtgagcctgaccgagtgcagcagattcctgaccagcatcaaggcctgcgacaaggccatctgctacggcgcccagagcagcaccctgatcagaggccagaacaccgtgaaggtgagcggcaagggcggccacagcggcagcagcttcaagtgctgccacggcaccgactgcagccagcagggcctgcaggccagcgccccccacctggacaagatcaacggcatcgtggagcaggagaacgagaaggtgtacgacgacggcgccccccagtgcggcatcagctgctggttcgtgaagagcggcgagtggatccagggcatcttcaacggcaactggatcgtgatcgtggtgctgatcttcttcttcatcctgagcctgatcctgctgagcatcttctgccccatcagaaagcacaagagaagctga

SEQ ID NO: 8380 - RNA, 3402 nt, synthetic construct
  misc_feature 1..3402: note = derived and/or modified CDS sequence (opt4) from DOBV(Ap1584/Sochi-01)__EU188450.1__GP
  source 1..3402: mol_type = other RNA
atgtggggcctgctgctgaccatgatcctgatcgacttcggcgccaccctgagaaacgtgtacgacatgagaatcgagtgcccccacagcgtgaacttcggcgagagcagcgtgagcggcaaggtggagctgccccccgtgctgctgagcgaggtggagaccctggtgcccgagagcagctgcaacatggacaaccaccagagcatgagcatcatccagaaggtgacccagctgacctggagaaagaaggccgacaaggcccaggccgccaaggacagcttcgagatcaccagcggcgaggtgagcctgaagggcacctgcaccctgacccacagaatggtggaggacagccacagaaacagaaagagcatcatctgctacgacctgagctgcaacagcacccactgcaagcccaccatgcacatgatcgtgcccatccacagctgcaacatgatgaagagctgcctggtgggcctgggcccctacagaatccaggtggtgtacgagagaacctactgcaccaccggcatcctgaccgagggcaagtgcttcgtgcccgaccagagcatcgtgaacgtgatcaagaacggcgtgttcgacatcgccagcgtgagcatcgtgtgcttcttcgtgagagtgaagggcaccaactacaagatcatggccagcatcaagaccgccaccagcaacaactgcaacgacaccggcaacaaggtgcagggctactacctgtgcatcgtgggcggcaacagcagccccgtgtacgtgcccagcaccaccgacttcagaagcatggaggccctggccagcatgctgagagccccccacggcgaggaccacgacctggccggcgaggaggtggccacctacagcatcgccggccaggtggagggcaaggtgccccacaccgccaacgccgccaacatgctgctgaccgccttcagcggcgtgcccagctacagcagcctgagcgtgttcaccggcagccaggacggccccatcgtgtacagccccggcctgttccccaagctgaaccagagcagctgcgacaaggtgggcctgcccctgatctgggagggctacatcgacctgcccggctactacgagaccgtgcaccagtgcaacgtgttctgcgtgctgagcggccccggcgccagctgcgaggccttcagcgagggcggcatcttcaacatcaccagccccaactgcatggtgagcaagcagaacagattcagagccgccgagcagcaggtgaacttcgcctgccagagcgtggaccaggacatcctgatcttctgcaacggccagaagaagaccatcctgaccaagaccctggtgatcggccagtgcatctaccccatcaccagcctgttcagcatcatgcccggcgtggcccacagcatcgccatcgagctgtgcgtgcccggcttccacggctgggccaccgccgccctgctgaccaccttctgcttcggctgggtgctgatccccagcatcaccctggccgtgctggtggtgctgaagttcttcgccgccatcctgcacaacagcagccaggagaacagattcaagctgatcctgaagaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagcccaccgagagcgccttccaggcccactacaaggtgtgccaggccacccacagattcagagacgacctgaagaagaccatcaccccccagagcaccagccccggctgctacagaaccctgaacctgttcagatacaagagcagatgctacatcttcaccgtgtgggtggtgctgctggtggtggagagcgtgatgtgggccgccagcgccagcgagaccgtgctggagcccagctggaacgacaacgcccacggcgtgggcgtggtgcccatgcacaccgacctggagctggacttcagcctgcccagcagcagcaagtacacctacaagagaaagctgaccagccccatcaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccagatgccacttcgagagagacttcgagtacgagaacagctggggctgcaaccccgccgactgccccggcatcggcaccggctgcaccgcctgcggcatctacatcgaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccagcacctgccagttcggcgaccccggcgacatcatgagccccaaggacaagggcttcagctgccccgagttcaccggccacttcagaaagaagtgcaacttcgccaccacccccgtgtgcgagtacgacggcaacatggtgagcggctacaagaaggtgatggccaccatcgacagcttccaggccttcaacaccagcagcatccactacaccgacgagagaatcgagtggaaggaccccgacggcatgctgaaggaccacctgaacatcctggtgaccaaggacatcgacttcgagaacctgggcgacagcccctgcaaggtgggcctgcagaccgtgagcatcgagggcgcctggggcagcggcgtgggcttcaccctgacctgccaggtgagcctgaccgagtgcagcagattcctgaccagcatcaaggcctgcgacaaggccatctgctacggcgcccagagcagcaccctgatcagaggccagaacaccgtgaaggtgagcggcaagggcggccacagcggcagcagcttcaagtgctgccacggcaccgactgcagccagcagggcctgcaggccagcgccccccacctggacaagatcaacggcatcgtggagcaggagaacgagaaggtgtacgacgacggcgccccccagtgcggcatcagctgctggttcgtgaagagcggcgagtggatccagggcatcttcaacggcaactggatcgtgatcgtggtgctgatcttcttcttcatcctgagcctgatcctgctgagcatcttctgccccatcagaaagcacaagagaagctga

SEQ ID NO: 8381 - RNA, 3408 nt, synthetic construct
  misc_feature 1..3408: note = derived and/or modified CDS sequence (opt4) from DOBV(GER/05/477/Af)__GQ205411.1__GP
  source 1..3408: mol_type = other RNA
atgatcatgtggggcctgctgctgaccctgagcctgatcaacctgggcgccagcctgagaaacgtgtacgacatgaagatcgagtgcccccacagcatcaacttcggcgagagcagcgtgaccggcaaggtggagctgccccccctgctgctgaccgacgccgaggccctggtgcccgagagcagctgcaacatggacaaccaccagagcctgagcatcacccagaaggtgaccaaggtgagctggagaaagaaggccgacaaggtgcaggccgccaaggacagcttcgagaccaccagcagcgaggtgaacttcaagggcacctgcaccctgacccacagaatggtggaggagagctacagaaacagaaagagcgtgatctgctacgacctgagctgcaacagcacccactgcaagcccaccatgcacatgatcgtgcccgtgcacagctgcaacatgatgaagagctgcctggtgggcctgggcccctacagaatccaggtggtgtacgagagaacctactgcaccaccggcatcctgaccgagggcaagtgcttcgtgcccgaccagagcatcatcagcgtgctgaagaacggcgtgttcgacatcgccagcgtgagcatcgtgtgcttcttcatcagaatcaagggcaccagctacaagatcatgaccagcatcaaggaggccaaccccaacaactgcaacgacaccgacaacaaggtgcagggctactacctgtgcatcgtgggcgccaacagcagccccgtgtacgcccccagcaccaccgacttcagaagcgtggaggccctggccagcctgctgagaagcccccacggcgaggaccacgacctggccggcgaggaggtggccacctacagcatcgccggccaggtggagggcaaggtgccccacaccgccaacgccgccaacatgctgttcaccgccttcagcggcatccccagctacagcagcttcagcgtgttcaccggcaaccaggagggcaacgtgatctacagccccggcctgttccccaagctgaaccagagcagctgcgagaaggtggccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcagatcaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatccccagcatcaccctggccatcctgatcatcctgaagttcttcgccgccctgttccacaacagcagccaggagaacagattcaagatcatcctgaagaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagctgaccgagagcgccttccaggcccactacagagtgtgccaggccacccacagattcagagacgacctgaagaagaccatcaccccccagagcaccagccccggctgctacagaaccctgaacctgttcagatacaagagcagatgctacatcttcaccgtgtgggtgatcctgctgatcatcgagagcatcctgtgggccgccagcgccagcgagaccgtgctggagcccagctggaacgacaacgcccacggcgtgggcgtggtgcccatgcacaccgacctggagctggacttcagcctgcccagcagcagcaagtacacctacaagagaaagctgaccagccccatcaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacagctggagctgcaaccccgccgactgccccggcatcggcaccggctgcaccgcctgcggcctgtacctggaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccaccacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccaggccttcaacaccagcaacatccactacaccgacgagagaatcgagtggaaggaccccgacggcatgctgaaggaccacctgaacatcctggtgaccaaggacatcgacttcgagaacctgggcgagaacccctgcaaggtgggcctgcagaccgccagcatcgacggcgcctggggcagcggcgtgggcttcaccctgacctgccagatcagcctgaccgagtgcagcagattcctgaccagcatcaaggcctgcgacatggccatctgctacggcgcccagagcgtgaccctggtgagaggccagaacaccgtgagagtgagcggcaagggcggccacagcggcagcagcttcaagtgctgccacggcaccgactgcagccagcagggcctgcaggccagcgccccccacctggacaaggtgaacggcatcgtggagcaggagagcacccaggtgtacgacgacggcgccccccagtgcggcatcagctgctggttcgtgaagagcggcgagtggatcaagggcatcttcaacggcaactggatcgtgatcgtggtgctgatcttcctgttcctgctgagcctgatcctgctgagcttcctgtgccccatcagaaagcacaagagaagctga

SEQ ID NO: 8382 - RNA, 3408 nt, synthetic construct
  misc_feature 1..3408: note = derived and/or modified CDS sequence (opt4) from DOBV(GER/07/607/Af)__GQ205410.1__GP
  source 1..3408: mol_type = other RNA
atgatcatgtggggcctgctggtgaccctgagcctgatcaacctgggcgccagcctgagaaacgtgtacgacatgaagatcgagtgcccccacagcatcaacttcggcgagagcagcgtgaccggcaaggtggagctgccccccctgcccctgaccgacgccgagaccctggtgcccgagagcagctgcaacatggacaaccaccagagcctgagcatcacccagaaggtgaccaaggtgagctggagaaagaaggccgacaaggtgcaggccgccaaggacagcttcgagaccaccagcagcgagatgaacctgaagggcacctgcaccctgacccacagaatggtggaggagagctacagaaacagaaagagcgtgatctgctacgacctgagctgcaacagcacccactgcaagcccaccatgcacatgatcgtgcccgtgcacagctgcaacatgatgaagagctgcctggtgggcctgggcccctacagaatccaggtggtgtacgagagaacctactgcaccaccggcatcctgaccgagggcaagtgcttcgtgcccgaccagagcatcatcagcgtgatgaagaacggcgtgttcgacatcgccagcgtgagcatcgtgtgcttcttcatcagaatcaagggcaccagctacaagatcatgaccagcatcaaggaggccaaccccaacaactgcaacgacaccgacaccaaggtgcagggctactacctgtgcatcgtgggcgccaacagcagccccgtgtacgcccccagcaccaccgacttcagaagcgtggaggccctggccagcctgctgagaagcccccacggcgaggaccacgacctggccggcgaggaggtggccacctacagcatcgccggccaggtggagggcaaggtgccccacaccgccaacgccgccaacatgctgttcaccgccttcagcggcatccccagctacagcagcttcagcgtgttcaccggcaaccaggacggcaccgtgatctacagccccggcctgttccccaagctgaaccagagcagctgcgacaaggtggccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcagatcaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatccccagcatcaccctggccatcctgatcgtgctgaagttcttcgccgccctgctgcacaacagcagccaggagaacagattcaagatcatcctgaagaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagctgaccgagagcgccttccaggcccactacagagtgtgccaggccacccacagattcagagacgacctgaagaagaccatcaccccccagagcaccagccccggctgctacagaaccctgaacctgttcagatacaagagcagatgctacatcttcaccgtgtgggtgatcctgctgatcatcgagagcatcctgtgggccgccagcgccagcgagaccgtgctggagcccagctggaacgacaacgcccacggcgtgggcgtggtgcccatgcacgccgacctggagctggacttcagcctgcccagcagcagcaagtacacctacaagagaaagctgaccagccccatcaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacagctggagctgcaaccccgccgactgccccggcatcggcaccggctgcaccgcctgcggcctgtacctggaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccaccacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccaggccttcaacaccagcaacatccactacaccgacgagagaatcgagtggaaggaccccgacggcatgctgaaggaccacctgaacatcctggtgaccaaggacatcgacttcgagaacctgggcgagaacccctgcaaggtgggcctgcagaccgccagcatcgacggcgcctggggcagcggcgtgggcttcaccctgacctgccagatcagcctgaccgagtgcagcagattcctgaccagcatcaaggcctgcgacatggccatctgctacggcgcccagagcgtgaccctggtgagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggagagcacccaggtgtacgacgacggcgccccccagtgcggcatcagctgctggttcgtgaagagcggcgagtggatcaagggcatcttcagcggcaactggatcgtgatcgtggtgctgatcttcctgttcctgctgagcctgatcctgctgagcttcctgtgccccatcagaaagcacaagagaagctga

SEQ ID NO: 8383 - RNA, 3408 nt, synthetic construct
  misc_feature 1..3408: note = derived and/or modified CDS sequence (opt4) from DOBV(GER/08/118/Aa)__GQ205412.1__GP
  source 1..3408: mol_type = other RNA
atgatcatgtggggcctgctggtgatcctgagcctgatcaacctgggcgccagcctgagaaacgtgtacgacatgaagatcgagtgcccccacagcatcaacttcggcgagagcagcgtgaccggcaaggtggagctgccccccctgcccctgaccgacgccgagaccctggtgcccgagagcagctgcaacatggacaaccaccagagcctgagcatcacccagaaggtgaccaaggtgagctggagaaagaaggccgacaaggtgcaggccgccaaggacagcttcgagaccaccagcagcgagatcaacctgaagggcacctgcaccctgacccacagaatggtggaggagagctacagaaacagaaagagcgtgatctgctacgacctgagctgcaacagcacccactgcaagcccaccatgcacatgatcgtgcccgtgcacagctgcaacatgatgaagagctgcctggtgggcctgggcccctacagaatccaggtggtgtacgagagaacctactgcaccaccggcatcctgaccgagggcaagtgcttcgtgcccgaccagagcatcatcagcgtgatgaagaacggcgtgttcgacatcgccagcgtgagcatcgtgtgcttcttcatcagaatcaagggcaccagctacaagatcatgaccagcatcaaggaggccaaccccaacaactgcaacgacaccgacaacaaggtgcagggctactacctgtgcatcgtgggcgccaacagcagccccgtgtacgcccccagcaccaccgacttcagaagcgtggaggccctggccagcctgctgagaagcccccacggcgaggaccacgacctggccggcgaggaggtggccacctacagcatcgccggccaggtggacggcaaggtgccccacaccgccaacgccgccaacatgctgttcaccgccttcagcggcatccccagctacagcagcttcagcgtgttcaccggcaaccaggacggcaccgtgatctacagccccggcctgttccccaagctgaaccagagcagctgcgacaaggtggccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcagatcaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatccccagcatcaccctggccatcctgatcgtgctgaagttcttcgccgccctgctgcacaacagcagccaggagaacagattcaagatcatcctgaagaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagctgaccgagagcgccttccaggcccactacagagtgtgccaggccacccacagattcagagacgacctgaagaagaccatcaccccccagagcaccagccccggctgctacagaaccctgaacctgttcagatacaagagcagatgctacatcttcaccgtgtgggtgatcctgctgatcatcgagagcatcctgtgggccgccagcgccagcgagaccatcctggagcccagctggaacgacaacgcccacggcgtgggcgtggtgcccatgcacaccgacctggagctggacttcagcctgcccagcagcagcaagtacacctacaagagaaagctgaccagccccatcaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacagctggagctgcaaccccgccgactgccccggcatcggcaccggctgcaccgcctgcggcctgtacctggaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccaccacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccaggccttcaacaccagcaacatccactacaccgacgagagaatcgagtgggaggaccccgacggcatgctgaaggaccacctgaacatcctggtgaccaaggacatcgacttcgagaacctgggcgagaacccctgcaaggtgggcctgcagaccgccagcatcgacggcgcctggggcagcggcgtgggcttcaccctgacctgccagatcagcctgaccgagtgcagcagattcctgaccagcatcaaggcctgcgacatggccatctgctacggcgcccagagcgtgaccctggtgagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggagagcacccaggtgtacgacgacggcgccccccagtgcggcatcagctgctggttcgtgaagagcggcgagtggatcaagggcgtgttcagcggcaactggatcgtgatcgtggtgctgatcttcctgttcctgctgagcctgatcctgctgagcttcctgtgccccatcagaaagcacaagagaagctga

SEQ ID NO: 8384 - RNA, 3408 nt, synthetic construct
  misc_feature 1..3408: note = derived and/or modified CDS sequence (opt4) from DOBV(GER/08/131/Af)__GQ205413.1__GP
  source 1..3408: mol_type = other RNA
atgatcatgtggggcctgctgctgaccctgagcctgatcaacctgggcgccagcctgagaaacgtgtacgacatgaagatcgagtgcccccacagcatcaacttcggcgagagcagcgtgaccggcaaggtggagctgccccccctgctgctgaccgacgccgagaccctggtgcccgagagcagctgcaacatggacaaccaccagagcctgagcatcacccagaaggtgaccaaggtgagctggagaaagaaggccgacaaggtgcaggccgccaaggacagcttcgagaccaccagcagcgaggtgaacctgaagggcacctgcaccctgacccacagaatggtggaggagagctacagaagcagaaagagcgtgatctgctacgacctgagctgcaacagcacccactgcaagcccaccatgcacatgatcgtgcccgtgcacagctgcaacatgatgaagagctgcctggtgggcctgggcccctacagaatccaggtggtgtacgagagaacctactgcaccaccggcatcctgaccgagggcaagtgcttcgtgcccgaccagagcatcatcagcgtgatcaagaacggcgtgttcgacatcgccagcgtgagcatcgtgtgcttcttcatcagaatcaagggcaccagctacaagatcatgaccagcatcaaggagagcaaccccaacaactgcaacgacaccgacaacaaggtgcagggctactacctgtgcatcgtgggcgccaacagcagccccgtgtacgcccccagcaccaccgacttcagaagcgtggaggccctggccagcctgctgagaagcccctacggcgaggaccacgacctggccggcgaggaggtggccacctacagcatcgccggccaggtggagggcaaggtgccccacaccgccaacgccgccaacatgctgttcaccgccttcagcggcatccccagctacagcagcttcagcgtgttcaccggcaaccaggacggcaacgtgatctacagccccggcctgttccccaagctgaaccagagcagctgcgagaaggtggccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcagatcaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatccccagcatcaccctggccatcctgatcgtgctgaagttcttcgccgccctgctgcacaacagcagccaggagaacagattcaagatcatcctgaagaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagctgaccgagagcgccttccaggcccactacagagtgtgccaggccacccacagattcagagacgacctgaagaagaccatcaccccccagagcaccagccccggctgctacagaaccctgaacctgttcagatacaagagcagatgctacatcttcaccgtgtgggtgatcctgctgatcatcgagagcatcctgtgggccgccagcgccagcgagatcgtgctggagcccagctggaacgacaacgcccacggcgtgggcgtggtgcccatgcacaccgacctggagctggacttcagcctgcccagcagcagcaagtacacctacaagagaaagctgaccagccccatcaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacagctggagctgcaaccccgccgactgccccggcatcggcaccggctgcaccgcctgcggcctgtacctggaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccaccacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccaggccttcaacaccagcaacatccactacaccgacgagagaatcgagtggaaggacaccgacggcatgctgaaggaccacctgaacatcctggtgaccaaggacatcgacttcgagaacctgggcgagaacccctgcaaggtgggcctgcagaccgccagcatcgacggcgcctggggcagcggcgtgggcttcaccctgacctgccagatcagcctgaccgagtgcagcagattcctgaccagcatcaaggcctgcgacatggccatctgctacggcgcccagagcgtgaccctggtgagaggccagaacaccgtgagagtgagcggcaagggcggccacagcggcagcagcttcaagtgctgccacggcaccgactgcagccaccagggcctgcaggccagcgccccccacctggacaaggtgaacggcatcgtggagcaggagagcacccaggtgtacgacgacggcgccccccagtgcggcatcagctgctggttcgtgaagagcggcgagtggatcaagggcatcttcagcggcaactggatcgtgatcgtggtgctgatcttcctgttcctgctgagcctgatcctgctgagcttcctgtgccccatcagaaagcacaagagaagctga

SEQ ID NO: 8385 - RNA, 3408 nt, synthetic construct
  misc_feature 1..3408: note = derived and/or modified CDS sequence (opt4) from DOBV(GRW/Aa)__JQ026205.1__GP
  source 1..3408: mol_type = other RNA
atgatcatgtggggcctgctgctgaccctgagcctgatcaacctgggcgccagcctgagaaacgtgtacgacatgaagatcgagtgcccccacagcatcaacttcggcgagagcagcgtgaccggcaagggcgagctgccccccctgctgctgaccgacgccgagaccctggtgcccgagagcagctgcaacatggacaaccaccagagcctgagcatcacccagaaggtgaccaaggtgagctggagaaagaaggccgacaaggtgcaggccgccaaggacagcttcgagaccaccagcagcgaggtgaacctgaagggcacctgcaccctgacccacagaatggtggaggagagctacagaagcagaaagagcgtgatctgctacgacctgagctgcaacagcacccactgcaagcccaccatgcacatgatcgtgcccgtgcacagctgcaacatgatgaagagctgcctggtgggcctgggcccctacagaatccaggtggtgtacgagagaacctactgcaccaccggcatcctgaccgagggcaagtgcttcgtgcccgaccagagcatcatcagcgtgatcaagaacggcgtgttcgacatcgccagcgtgagcatcgtgtgcttcttcatcagaatcaagggcaccagctacaagatcatgaccagcatcaaggagagcaaccccaacaactgcaacgacaccgacaacaaggtgcagggctactacctgtgcatcgtgggcgccaacagcagccccgtgtacgcccccagcaccaccgacttcagaagcgtggaggccctggccagcctgctgagaagcccctacggcgaggaccacgacctggccggcgaggaggtggccacctacagcatcgccggccaggtggagggcaaggtgccccacaccgccaacgccgccaacatgctgttcaccgccttcagcggcatccccagctacagcagcttcagcgtgttcaccggcaaccaggacggcaacgtgatctacagccccggcctgttccccaagctgaaccagagcagctgcgagaaggtggccctgcccctgatctgggagggctacatcgacctgcccggctactacgagaccgtgcacccctgcaacgtgttctgcgtgagcagcggccccggcgccagctgcgaggccttcagcgagggcggcatcttcaacatcaccagccccacctgcctggtgagcaagcagaacagattcagagccgccgagcagcagatcaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatccccagcatcaccctggccatcctgatcgtgctgaagttcttcgccgccctgctgcacaacagcagccaggagaacagattcaagatcatcctgaagaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagctgaccgagagcgccttccaggcccactacagagtgtgccaggccacccacagattcagagacgacctgaagaagaccatcaccccccagagcaccagccccggctgctacagaaccctgaacctgttcagatacaagagcagatgctacatcttcaccgtgtgggtgatcctgctgatcatcgagagcatcctgtgggccgccagcgccagcgagatcgtgctggagcccagctggaacgacaacgcccacggcgtgggcgtggtgcccatgcacaccgacctggagctggacttcagcctgcccagcagcagcaagtacacctacaagagaaagctgaccagccccatcaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacagctggagctgcaaccccgccgactgccccggcatcggcaccggctgcaccgcctgcggcctgtacctggaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccaccacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccaggccttcaacaccagcaacatccactacaccgacgagagaatcgagtggaaggaccccgacggcatgctgaaggaccacctgaacatcctggtgaccaaggacatcgacttcgagaacctgggcgagaacccctgcaaggtgggcctgcagaccgccagcatcgacggcgcctggggcagcggcgtgggcttcaccctgacctgccagatcagcctgaccgagtgcagcagattcctgaccagcatcaaggcctgcgacatggccatctgctacggcgcccagagcgtgaccctggtgagaggccagaacaccgtgagagtgagcggcaagggcggccacagcggcagcagcttcaagtgctgccacggcaccgactgcagccaccagggcctgcaggccagcgccccccacctggacaaggtgaacggcatcgtggagcaggagagcacccaggtgtacgacgacggcgccccccagtgcggcatcagctgctggttcatcaagagcggcgagtggatcaagggcatcttcagcggcaactggatcgtgatcgtggtgctgatcttcctgttcctgctgagcctgatcctgctgagcttcctgtgccccatcagaaagcacaagagaagctga

SEQ ID NO: 8386 - RNA, 3408 nt, synthetic construct
  misc_feature 1..3408: note = derived and/or modified CDS sequence (opt4) from DOBV(Slo/Af-BER)__GU904035.1__GP
  source 1..3408: mol_type = other RNA
atgatcatgtggggcctgctgctgaccatgatcctgatcgacttcggcgccagcctgagaaacgtgtacgacatgaagatcgagtgcccccacagcatcaacttcggcgagagcagcgtgaccggcaaggtggagctgccccccctgctgctgaccgacgccgaggccctggtgcccgagagcagctgcaacatggacaaccaccagagcatgagcatcatccagaaggtgaccaaggtgagctggagaaagaaggccgacaaggcccaggccgccaaggacagcttcgagaccaccagcagcgaggtgaacctgaagggcacctgcaccctgagccacagaatggtggaggagagctacagaaacagaagaagcgtgatctgctacgacctgagctgcaacagcacccactgcaagcccaccatgcacatgatcgtgcccgtgcacagctgcaacatgatgaagagctgcctggtgggcctgggcccctacagaatccaggtggtgtacgagagaacctactgcaccaccggcatcctgaccgagggcaagtgcttcgtgcccgaccagagcatcgtgagcgtgatcaagaacggcgtgttcgacatcgccagcgtgagcatcgtgtgcttcttcatcagagtgaagggcaccaactacaagatcatggccagcatcaagaccgccaccgccaacaactgcaacgacaccgacaacaaggtgcagggctactacctgtgcatcgtgggcggcaacagcagccccgtgtacgcccccagcaccaccgacttcagaagcatggaggccctggccagcctgctgagagccccccacggcgaggaccacgacctgagcggcgaggaggtggccacctacagcatcgccggccagatcgagggcaagatcccccacaccgccaacgccgccaacatgctgttcaccgccttcagcggcatccccagctacagcagcctgagcgtgttcatcggcagccaggacggccccatcatctacagccccggcctgttccccaagctgaaccagagcagctgcgacaaggtggccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcaggtgaacttcgtgtgccagagagtggaccaggacatcatcatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatccccagcatcaccctggccgtgctggtggtgctgaagttcttcgccgccatcctgcacaacagcagccaggagaacagattcaagatcatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagcccaccgagagcgccttccaggcccactacaaggtgtgccaggccacccacagattcagagacgacctgaagaagaccatcaccccccagagcaccagccccggctgctacagaaccctgaacctgttcagatacaagagcagatgctacatcttcaccgtgtgggtgaccctgctgatcatcgagagcatcatgtgggccgccagcgccagcgagaacgtgctggagcccagctggaacgacaacgcccacggcgtgggcgtggtgcccatgcacaccgacctggagctggacttcagcctgcccagcagcagcaagtacacctacaagagaaagctgaccagccccctgaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacagctggggctgcaaccccgccgactgccccggcatcggcaccggctgcaccgcctgcggcctgtacatcgaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccagcacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccagagcttcaacaccagcagcatccactacaccgacgagagaatcgagtggaaggaccccgacggcatgctgaaggaccacctgaacatcctggtgaccaaggacatcgacttcgagaacctgggcgagaacccctgcaaggtgggcctgcagaccagcagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctgatcagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggacagcgagaaggtgtacgacgacggcgccccccagtgcggcatcagctgctggttcgtgaagagcggcgagtggatcaccggcatcttcaacggcaactggatcgtgatcgtggtgctggtgttcttcttcatcctgagcctgatcctgctgagcctgctgtgccccatcagaaagcacaagagaagctga

SEQ ID NO: 8387 - RNA, 3408 nt, synthetic construct
  misc_feature 1..3408: note = derived and/or modified CDS sequence (opt4) from HTNV(76-118/POR)__KT885048.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcggcaacagcgtgatcggctacgtggagctgccccccgtgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcgtgacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagactgatcgcctacagcggcatccccagctacagcagcctgagcatcctgaccagcagcaccgaggccaagcacgtgttcagccccggcctgttccccaagctgaaccacaccaactgcgacaagagcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagcagcatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8388 - RNA, 3408 nt, synthetic construct
  misc_feature 1..3408: note = derived and/or modified CDS sequence (opt4) from HTNV(76-118)__Y00386.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcggcaacagcgtgatcggctacgtggagctgccccccgtgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcgtgacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcctgttccccaagctgaaccacaccaactgcgacaagagcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcagatgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8389 - RNA, 3408 nt, synthetic construct
  misc_feature 1..3408: note = derived and/or modified CDS sequence (opt4) from HTNV(A16)__AF288645.1__GP
  source 1..3408: mol_type = other RNA
atgggcctgtggaagtggctgatcatggccgtgctggtgtggccctgcttcgccctgagaaacgtgtacgacatgaagatcgagtgcccccacaccgtgaacttcggcgagaacagcgtggtgggctacgtggagctgccccccatgcccatcgccgacatcacccagatgatgcccgagagcagctgcagcatggacaaccaccagagcctgaacaccatcaccaagtacacccaggtgagctggagaaagaaggccgaccaggcccagagcagccagaccagcttcgagaccgtgagcagcgaggtggacttcaagggcacctgcgtgctgaagcacaagatgatcgaggacagctacagaagcagaagaagcatcatctgctacgacctgagctgcaacagcaccttctgcaagcccaccctgtacctgatcgtgcccgtgcacgcctgcaacatgatgaagagctgcctgatcgccctgggcccctacagagtgcaggtggtgtacgagagaacctactgcatgagcggcgtgctgctggagggcaagtgcttcgtgcccgaccagagcgtggtgagcatcatcaagcacggcatcttcgacatcgccagcgtgcacatcgtgtgcttcttcgtggccatcaagggcagcacctacaagatcctggagcaggtgaagaagagcttcgagctgacctgcaacgacaccgacaacaagatccagggctactacatctgcctggtgggcggcaacagcgcccccatctacgtgcccaccctggacgacttcagaagcatggaggccttcgccggcatcttcaagagcccccacggcgaggaccacgacctggccggcgaggaggtggccagctacagcatcgtgggccccgccaacgccaaggtgccccacagcgccagcgccgacaccctgggcctggtggccttcagcggcatccccagctacagcagcttcagcgtgctgaccggcagcaccgacgccagacacgtgttcagccccggcttcttcccccagctgaaccagaccagatgcgacaagaccgccatccccctgacctggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagaagcagcaagcagcaggtgaacttcgtgtgccagagagtggacatggacatcgtggtgtactgcaacggccagaagaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccgtgaccctggtgatcctgaccatcctgaagttcatcgccaacatcttccacaccagcaaccaggagaacagactgaagagcgtgctgaagaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctgatcctggagagcatcctgtgggccgccagcgccagcgagacccccctgacccccatctggaacgacaacgcccacggcgtgggcagcatccccatgcacaccgacctggagctggacttcagcctgaccagcagcagcaagtacacctacagaagaaagctgaccaaccccctggaggagacccaggccgtggacctgcacatcgagctggccgagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatgatcagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagaccggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8390 - RNA, 3408 nt, synthetic construct
  misc_feature 1..3408: note = derived and/or modified CDS sequence (opt4) from HTNV(A9)__AF035831.1__GP
  source 1..3408: mol_type = other RNA
atgggcatctggaagtggctggtgatggccagcctggtgtggcccgcctacaccctgagaaacgcctacgacatgaagatcgagtgcccccacaccgtgagcttcggcgagaacagcgtgatcggctacgtggagctgccccccatccccctggccgacaccacccagatggtgcccgagagcagctgcagcatggacaaccaccagagcctgaacaccatcaccaagtacacccaggtgagctggagaggcaaggccgaccacgcccaggccagccagaacagcttcgaggccgtgagcgccgaggtggacctgaagggcacctgcgtgctgaagcacaagatgctggaggagagctacagaagcagaaagagcatcgcctgctacgacctgagctgcaacagcacctactgcaagcccaccctgtacatgatcgtgcccatccacgcctgcaacatgatgaagagctgcctgatcgccctgggcccccacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcagatcaagaagagcttcgagagcacctgcaacgacaccaagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgaccgcctacagcggcatccccagctacagcagcctgagcatcctggccggcagcgccgaggccaagcacgtgttcagccccggcttcttcccccagctgaaccacaccaagtgcgacaagaccgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatgaccttcatcgtgctgaccatcctgaagttcatcgccaacatcttccacaccagcaaccaggagaacaagctgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgagatccccctgaaccccgtgtggaacgacaacgcccacggcgtgggcagcgtgcccatgcccaccgacctggagctggacttcagcctgaccagcagcagcaagtacacctacagaagaaagctgaccaaccccctggaggagagccaggccatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgagagccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcagcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgagaacctgggcggcaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctgatcctgctgagcatcctgtgccccgtgagaaagcacaagaagagctga

SEQ ID NO: 8391 - RNA, 3408 nt, synthetic construct
  misc_feature 1..3408: note = derived and/or modified CDS sequence (opt4) from HTNV(84FLi)__AF345636.2__GP
  source 1..3408: mol_type = other RNA
atgggcgtgtggaagtggctggtgatggccagcctggtgtggcccgcctgcaccctgagaaacgtgtacgacatgaagatcgagtgcccccacaccgtgagcttcggcgagaacagcgtgatcggctacgtggagctgccccccatgcccctggccgacaccacccagctggtgcccgagagcagctgcagcatggacaaccaccagagcctgaacaccatcaccaagtacacccaggtgagctggagaaagaaggccgaccaggcccagagcagccagaacagcttcgagaccgtgagcgtggaggtggacctgaagggcacctgcgtgctgaagcacaagatgatcgaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgaagatcgtgtgcttcttcgtggccgtgaagggcaacacctacaagctgttcgagcaggtgaagaagagcttcgacagcacctgcaacgacaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggaggtggccagctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcttcttcccccagctgaaccacaccaagtgcgacaagaccgccatccccctgacctggaccggcatgatcgacctgcccggctactacgaggccatccacctgtgcaccgtgttctgcgtgctgagcggccccggcgccagctgcgaggccttcagcgagggcggcatcttcaacatcaccagccccatgtgcctggtgagcaagcagaaccagttcagactgaccaagcagcaggtgaacttcgtgtgccagagagtggacatggacatcgtggtgtactgcaacggccagagaaaggtgatcctgaccaagaccatggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccgtgaccttcatcatcctgaccgtgctgaagttcgtggccaacatcttccacaccagcaaccaggagaacagactgaagagcgtgctgagaaagatcaaggaggagttcgagaagaccaagggcagcatggtgtgcgacgtgtgcaagtacgagtgcgagacctacagagagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgaggtgcccctgaaccccatctggaacgacaacgcccacggcgtgggcagcgtgcccatgcacaccgacctggagctggacttcagcctgaccagcagcagcaagtacacctacagaagaaagctgaccaaccccctggaggagacccaggccatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatgatcagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagaccggcctgcacgccgccgccccccacctggacaaggtgaacggcatcagcgagatcgagaacagcaaggtgtacgacgacggcgccccccagtgcggcatcaagtgctggttcgtgaccagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8392 - RNA, 3408 nt, synthetic construct
  misc_feature 1..3408: note = derived and/or modified CDS sequence (opt4) from HTNV(Aa03-161)__KT934990.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacagaaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8393 - RNA, 3408 nt, synthetic construct
  misc_feature 1..3408: note = derived and/or modified CDS sequence (opt4) from HTNV(Aa03-386)__KT934991.1__GP
  source 1..3408: mol_type = other RNA
atgggcatctggaagtggctggtgatggccagcctggtgtggcccgtgctgaccctgagaaacgtgtacgacatgaagatcgagtgcccccacaccatcagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcatcttcctgctgttcagcctggtgctgctgagcatcctgtgccccgtgagaaagcacaagaagagctga

SEQ ID NO: 8394 - RNA, 3408 nt, synthetic construct
  misc_feature 1..3408: note = derived and/or modified CDS sequence (opt4) from HTNV(Aa04-722)__KU207182.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatcatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8395 - RNA, 3408 nt, synthetic construct
  misc_feature 1..3408: note = derived and/or modified CDS sequence (opt4) from HTNV(Aa05-190)__KT934993.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctgaccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatgatcgaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8396 - RNA, 3408 nt, synthetic construct
  misc_feature 1..3408: note = derived and/or modified CDS sequence (opt4) from HTNV(Aa09-1000)__KT935001.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8397 - RNA, 3408 nt, synthetic construct
  misc_feature 1..3408: note = derived and/or modified CDS sequence (opt4) from HTNV(Aa09-948)__KT935000.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctgatcagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8398 - RNA, 3408 nt, synthetic construct
  misc_feature 1..3408: note = derived and/or modified CDS sequence (opt4) from HTNV(Aa10-434)__KT935004.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcggcaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagatcagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccatcagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcaggccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8399 - RNA, 3408 nt, synthetic construct
  misc_feature 1..3408: note = derived and/or modified CDS sequence (opt4) from HTNV(Aa10-518)__KT935005.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccaagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcgtggacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8400 - RNA, 3408 nt, synthetic construct
  misc_feature 1..3408: note = derived and/or modified CDS sequence (opt4) from HTNV(Aa10-561)__KT935006.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagatcagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccatcagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcaggccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8401 - RNA, 3408 nt, synthetic construct
  misc_feature 1..3408: note = derived and/or modified CDS sequence (opt4) from HTNV(Aa14-172)__KT935008.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctgaccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatgatcgaggagagctacagaagcagaaagagcatcacctgctacgacctgagctgcaacaacacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgaggtggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8402 - RNA, 3408 nt, synthetic construct
  misc_feature 1..3408: note = derived and/or modified CDS sequence (opt4) from HTNV(Aa14-266)__KT935013.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcctgaacaccatcaccaagtacacccaggtgagctggagaggcaaggccgaccagagccagagcaaccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccacctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcctgttccccaagctgaaccacaccaactgcgacaagagcgccatccccctgatgtggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagaccatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8403 - RNA, 3408 nt, synthetic construct
  misc_feature 1..3408: note = derived and/or modified CDS sequence (opt4) from HTNV(Aa14-272)__KT935014.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcctgaacaccatcaccaagtacacccaggtgagctggagaggcaaggccgaccagagccagagcaaccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccacctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcctgttccccaagctgaaccacaccaactgcgacaagagcgccatccccctgatgtggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8404 - RNA, 3408 nt, synthetic construct
  misc_feature 1..3408: note = derived and/or modified CDS sequence (opt4) from HTNV(Aa14-362)__KT935015.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgaggccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8405 - RNA, 3408 nt, synthetic construct
  misc_feature 1..3408: note = derived and/or modified CDS sequence (opt4) from HTNV(Aa14-404)__KT935018.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccacctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcctgttccccaagctgaaccacaccaactgcgacaagagcgccatccccctgatgtggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccaccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8406 - RNA, 3408 nt, synthetic construct
  misc_feature 1..3408: note = derived and/or modified CDS sequence (opt4) from HTNV(Aa14-423)__KT935022.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccacctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcctgttccccaagctgaaccacaccaactgcgacaagagcgccatccccctgatgtggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccaccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8407 - RNA, 3408 nt, synthetic construct
  misc_feature 1..3408: note = derived and/or modified CDS sequence (opt4) from HTNV(Aa15-56)__KU207187.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaagaaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgccctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8408 - RNA, 3408 nt, synthetic construct
  misc_feature 1..3408: note = derived and/or modified CDS sequence (opt4) from HTNV(CBAa11-106)__KC576787.1__GP
  source 1..3408: mol_type = other RNA
atgggcatgtggaagtggctggtgatcgccagcctggtgtggcccgccctgaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcatgaacaccatcaccaagtacacccaggtgatctggagaggcaaggccgaccccggccagagcagccagaacagcttcgagaccgtgagcaccgagatcgacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttcgagagcacctgcaacgacaccgagaacaaggtgcagggctactacatctgcatcgtgggcggcaacttcgcccccatctacgtgcccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcctgttccccaagctgaaccacaccaactgcgacaagagcgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcgtggccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctgatcctggagagcgtgctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8409 - RNA, 3408 nt, synthetic construct
  misc_feature 1..3408: note = derived and/or modified CDS sequence (opt4) from HTNV(CBAa11-26)__KC576786.1__GP
  source 1..3408: mol_type = other RNA
atgggcatgtggaagtggctggtgatcgccagcctggtgtggcccgccctgaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcatgaacaccatcaccaagtacacccaggtgatctggagaggcaaggccgaccccggccagagcagccagaacagcttcgagaccgtgagcaccgagatcgacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcctgttccccaagctgaaccacaccaactgcgacaagagcgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcgtggccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctgatcctggagagcgtgctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8410 - RNA, 3408 nt, synthetic construct
  misc_feature 1..3408: note = derived and/or modified CDS sequence (opt4) from HTNV(Fuyuan-Aa-145)__KJ857336.1__GP
  source 1..3408: mol_type = other RNA
atgggcatgtggaagtggctggtgatcgccagcctggtgtggcccgccctgagcctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcatcaacaccatcaccaagtacacccaggtgatctggagaggcaaggccgaccccggccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcaccttctgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacgtggtgtgcttcttcgtggccgtgaagggcaacacctacaagctgttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcaagagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctgaccagcagcaccgacgccaagcacgtgttcagccccggcctgttccccaagctgaaccacaccaactgcgacaagagcgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccgtgaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctgatcctggagagcgtgctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagcaagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8411 - RNA, 3408 nt, synthetic construct
  misc_feature 1..3408: note = derived and/or modified CDS sequence (opt4) from HTNV(Fuyuan-Aa-26)__KJ857334.1__GP
  source 1..3408: mol_type = other RNA
atgggcatgtggaagtggctggtgatcgccagcctggtgtggcccgccctgagcctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcatcaacaccatcaccaagtacacccaggtgatctggagaggcaaggccgaccccggccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcaagagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctgaccagcagcaccgacgccaagcacgtgttcagccccggcctgttccccaagctgaaccacaccaactgcgacaagagcgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccgtgaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctgatcctggagagcgtgctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagcaagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8412 - RNA, 3408 nt, synthetic construct
  misc_feature 1..3408: note = derived and/or modified CDS sequence (opt4) from HTNV(JS1)__KP970560.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcggcaacagcgtgatcggctacgtggagctgccccccgtgcccctggccgacaccgcccagatggtgcccgagagcagctgcagcatggacaaccaccagagcctgaacaccatcgccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcgtgacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcctgttccccaagctgaaccacaccaactgcgacaagagcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgagggcaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8413 - RNA, 3408 nt, synthetic construct
  misc_feature 1..3408: note = derived and/or modified CDS sequence (opt4) from HTNV(LongquanAa-08-150)__JQ912803.1__GP
  source 1..3408: mol_type = other RNA
atgggcatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcatctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgctggagggcaagtgcttcgtgcccgaccagagcgtggtgagcatcatcaagcacggcatcttcgacatcgccagcgtgcacatcgtgtgcttcttcgtggccgtgaagggcaacacctacaagctgctggagcaggtgaagaagagcttccagagcacctgcaacgacaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgatctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacacctgcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8414 - RNA, 3408 nt, synthetic construct
  misc_feature 1..3408: note = derived and/or modified CDS sequence (opt4) from HTNV(LongquanAa-08-157)__JQ912804.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgagccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacctgttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8415 - RNA, 3408 nt, synthetic construct
  misc_feature 1..3408: note = derived and/or modified CDS sequence (opt4) from HTNV(LongquanAa-08-196)__JQ912805.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8416 - RNA, 3408 nt, synthetic construct
  misc_feature 1..3408: note = derived and/or modified CDS sequence (opt4) from HTNV(LongquanAa-08-235)__JQ912810.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgttcgagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcgtgaactggatcgtgctgatcgtgctgtgcgtgttcctgctgttcagcctggtgctgctgagcgtgctgtgccccgtgagaaagcacaagaagagctga

SEQ ID NO: 8417 - RNA, 3408 nt, synthetic construct
  misc_feature 1..3408: note = derived and/or modified CDS sequence (opt4) from HTNV(LongquanAa-09-171)__JQ912824.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccaacaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8418 - RNA, 3408 nt, synthetic construct
  misc_feature 1..3408: note = derived and/or modified CDS sequence (opt4) from HTNV(LongquanAa-09-191)__JQ912825.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgcccagaatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8419 - RNA, 3408 nt, synthetic construct
  misc_feature 1..3408: note = derived and/or modified CDS sequence (opt4) from HTNV(LongquanAa-09-350)__JQ912835.1__GP
  source 1..3408: mol_type = other RNA
atggagatctggaagtggctggtgatggccagcctggtgtggcccgccttcaccagaagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgagaagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8420 - RNA, 3408 nt, synthetic construct
  misc_feature 1..3408: note = derived and/or modified CDS sequence (opt4) from HTNV(LongquanAa-09-489)__JQ912844.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgcccagaatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctgcagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8421 - RNA, 3408 nt, synthetic construct
  misc_feature 1..3408: note = derived and/or modified CDS sequence (opt4) from HTNV(LongquanAa-09-541)__JQ912850.1__GP
  source 1..3408: mol_type = other RNA
atgggcatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcatctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgctggagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8422 - RNA, 3408 nt, synthetic construct
  misc_feature 1..3408: note = derived and/or modified CDS sequence (opt4) from HTNV(LongquanAa-09-698)__JQ912854.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcatcctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8423 - RNA, 3408 nt, synthetic construct
  misc_feature 1..3408: note = derived and/or modified CDS sequence (opt4) from HTNV(LongquanAa-10-393)__JQ912859.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggcagagtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8424 - RNA, 3408 nt, synthetic construct
  misc_feature 1..3408: note = derived and/or modified CDS sequence (opt4) from HTNV(LongquanAa-10-58)__JQ912861.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcctgttcctgctgttcagcctggtgctgctgagcgtgctgtgccccgtgagaaagcacaagaagagctga

SEQ ID NO: 8425 - RNA, 3408 nt, synthetic construct
  misc_feature 1..3408: note = derived and/or modified CDS sequence (opt4) from HTNV(LongquanAa-10-74)__JQ912864.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcgagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8426 - RNA, 3408 nt, synthetic construct
  misc_feature 1..3408: note = derived and/or modified CDS sequence (opt4) from HTNV(LongquanAa-10-98)__JQ912866.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgctggagcaggtgaagaagagcttccagagcacctgcaacgacaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8427 - RNA, 3408 nt, synthetic construct
  misc_feature 1..3408: note = derived and/or modified CDS sequence (opt4) from HTNV(LongquanAa-11-452)__KC344264.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatcaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgctggagcaggtgaagaagagcttccagagcacctgcaacgacaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcatcggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8428 - RNA, 3408 nt, synthetic construct
  misc_feature 1..3408: note = derived and/or modified CDS sequence (opt4) from HTNV(LongquanAa-11-473)__KC344263.1__GP
  source 1..3408: mol_type = other RNA
atgggcatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcatctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgctggagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacgacaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccaacagcaccgaggccaagcacgtgttcagccccggcttcttcccccagctgaaccacaccaagtgcgacaagaccgccatccccctgatctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcagatcaacttcgtgtgccagagagtggacgtggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8429 - RNA, 3408 nt, synthetic construct
  misc_feature 1..3408: note = derived and/or modified CDS sequence (opt4) from HTNV(LongquanAa-11-642)__KC344262.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgctggagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacgacaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgatctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8430 - RNA, 3408 nt, synthetic construct
  misc_feature 1..3408: note = derived and/or modified CDS sequence (opt4) from HTNV(LongquanAa-11-774)__KC344257.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgagaagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8431 - RNA, 3408 nt, synthetic construct
  misc_feature 1..3408: note = derived and/or modified CDS sequence (opt4) from HTNV(LongquanMf-09-8)__JQ912875.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaacaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8432 - RNA, 3408 nt, synthetic construct
  misc_feature 1..3408: note = derived and/or modified CDS sequence (opt4) from HTNV(ROKA14-11)__KU207203.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccagcacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8433 - RNA, 3408 nt, synthetic construct
  misc_feature 1..3408: note = derived and/or modified CDS sequence (opt4) from HTNV(US8A15-1)__KU207205.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagcactgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgaccgtgctgtgcgtgttcctgctgttcagcctggtgctgctgagcatcctgtgccccgtgagaaagcacaagaagagctga

SEQ ID NO: 8434 - RNA, 3408 nt, synthetic construct
  misc_feature 1..3408: note = derived and/or modified CDS sequence (opt4) from HTNV(Lee)__D00377.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaccagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagcgacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcacctaccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggagtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8435 - RNA, 3384 nt, synthetic construct
  misc_feature 1..3384: note = derived and/or modified CDS sequence (opt4) from HTNV(M)__U38177.1__GP
  source 1..3384: mol_type = other RNA
atggccagcctggtgtggcccgtgctgaccctgagaaacgtgtacgacatgaagatcgagtgcccccacaccgtgagcttcggcgagaacagcgtgatcggctacgtggagctgccccccgtgcccctggccgacaccgcccagatggtgcccgagagcagctgcaacatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcgtgacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaagctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccagctacagcatcgtgggcgccgccaacgccaaggtgccccacagcgccagcagcgacaccctgagactgatcgcctacagcggcatccccagctacagcagcctgagcatcctgaccagcagcaccgaggccaagcacgtgttcagccccggcctgttccccaagctgaaccacaccaactgcgacaagagcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8436 - RNA, 3408 nt, synthetic construct
  misc_feature 1..3408: note = derived and/or modified CDS sequence (opt4) from HTNV(N8)__EF077656.1__GP
  source 1..3408: mol_type = other RNA
atgggcatctggaagtggctggtgatggccagcctggtgtggcccgcctacaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacaacacctactgcaagcccaccctgtacatgatcgtgcccatccacgcctgcaacatgatgaagagctgcctgatcgccctgggcccctacagagtgcaggtgatctacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacgacaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctgaccggcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgagagccgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttcagcctgaccagcagcagcaagtacacctacagaagaagactgaccaaccccctggaggagacccaggccatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacatcgaccagctgaagcccgtgggcagcgcctacaagatcatcaccatcagatacagcagaaaggtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtggccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgaggtggagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8437 - RNA, 3408 nt, synthetic construct
  misc_feature 1..3408: note = derived and/or modified CDS sequence (opt4) from HTNV(Q32)__DQ371905.1__GP
  source 1..3408: mol_type = other RNA
atgggcatctggaagtggctggtgatggccagcctggtgtggcccgccttcgccctgagaaacgtgtacgacatgaagatcgagtgcccccacaccgtgagcttcggcgagaacagcgtgatcggctacgtggagctgccccccatgcccctggccgacaccacccagatggtgcccgagagcagctgcagcatggacaaccaccagagcctgaacaccatcaccaagtacacccagatcatctggagaggcaaggccgaccagagccagagcagccagaacagcttcgagaccgtgagcaccgaggtggacctgaagggcacctgcgtgctgaagcacaagatgatcgaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcaactgcaacgacaccgagaacaaggtgcagggctactacatctgcatcatcggcggcaacagcagccccgtgtacgtgcccaccctggacgacttcagaagcatggaggccttcagcggcatcttcagaagcccccacggcgaggaccacgacctggccggcgaggaggtggccagctacagcatcgtgggccccgccaacgccaaggtgccccacagcgccagcagcgacaccctgggcctgatcgcctacttcggcatccccagctacagcagcctgagcatcctgaccagcagcaccgaggccaagcacgtgttcagccccggcctgttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagagaaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgagatccccctgaaccccgtgtggaacgacaacgcccacggcgtgggcagcatccccatgcacaccgacctggagctggacttcagcctgaccagcagcagcaagtacacctacagaagaaagctgaccaaccccctggaggagagccaggccatcgacctgcacgtggagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgcagcaccttcctgaccagcatcaaggcctgcgacaaggccatctgctacggcgccgagagcgtgaccctgatcagaggccagaacaccgtgaaggtgagcggcaagggcggccacagcggcagcagcttcaagtgctgccacggcgaggagtgcagccagatcggcctgcacgccgccgccccccacctggacaaggtgaacggcatcagcgagatggagaacagcaaggtgttcgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8438 - RNA, 3408 nt, synthetic construct
  misc_feature 1..3408: note = derived and/or modified CDS sequence (opt4) from HTNV(Bao14)__AB127995.1__GP
  source 1..3408: mol_type = other RNA
atgggcatgtggaagtggctggtgatcgccagcctggtgtggcccgccctggccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcatcaacaccatcaccaagtacacccaggtgatctggagaggcaaggccgaccccggccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcaagagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctgaccagcagcaccgacgccaagcacgtgttcagccccggcctgttccccaagctgaaccacaccaactgcgacaagagcgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccgtgaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctgatcctggagagcgtgctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgagagtgagcggcaagggcggccacagcggcagcaccttcaagtgctgccacggcgaggactgcagcaagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8439 - RNA, 3408 nt, synthetic construct
  misc_feature 1..3408: note = derived and/or modified CDS sequence (opt4) from HTNV(HubeiHu02)__JQ665881.1__GP
  source 1..3408: mol_type = other RNA
atgggcatctggaagtggctggtgatggccagcctggtgtggcccgccttcgccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcctgaacaccatcaccaagtacacccagatcgtgtggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcagcacctacaagctgttcgagcaggtgaagaagagcttcgagagcaactgcaacgacaccgagaacaaggtgcagggccactacatctgcatcgtgggcggcaacagcgcccccatctacgtgcccaccctggacgacttcagaagcatggaggccttcagcggcatcttcaagagcccccacggcgaggaccacgacctggccggcgaggaggtggccagctacagcatcgtgggccccgccaacgccaaggtgccccacagcgccagcagcgacaccctgagcctgatcgcctacagcggcatccccagctacagcagcctgagcatcctgaccagcctgaccgaggccaagcacgtgttcagccccggcctgttcccccagctgaaccacaccaagtgcgacaagaccgccatccccctgacctggaccggcatgatcgacctgcccggctactacgaggccgtgcacccctgcaccgtgttctgcgtgctgagcggccccggcgccagctgcgaggccttcagcgagggcggcatcctgaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagagaaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgagacccccctgaaccccgtgtggaacgacaacgcccacggcgtgggcagcgtgcccatgcacaccgacctggagctggacttcagcctgaccagcagcagcaagtacacctacagaagaaagctgaccaaccccctggaggagagccaggccatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcagcatcctggtgaccaaggacatcgacttcgacaacctgggcgagaacccctgcaagatcggcctgcagaccagcagcatcgagggcgcctggggcagcggcgtgggctacaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcagcttcaagtgctgccacggcgaggactgcagccagatcggcctgcacgccgccgccccccacctggacaaggtgaacggcatcagcgagatcgagaacagcaaggtgttcgacgacggcgccccccagtgcggcatcaagtgctggttcgtgaagagcggcgagtggatcagcggcatcttcaacggcaactggatcgtgctgatcgtgctgtgcgtgttcctgctgttcagcctggtgctgctgagcatcctgtgccccgtgagaaagcacaagaagagctga

SEQ ID NO: 8440 - RNA, 3408 nt, synthetic construct
  misc_feature 1..3408: note = derived and/or modified CDS sequence (opt4) from HTNV(HV004)__JQ083394.1__GP
  source 1..3408: mol_type = other RNA
atgggcatctggaagtggctggtgatggccagcctggtgtggcccgccttcgccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcctgaacaccatcaccaagtacacccagatcatctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcagcacctacaagctgttcgagcaggtgaagaagagcttcgagagcaactgcaacgacaccgagaacaaggtgcagggctactacatctgcatcgtgggcggcaacagcgcccccatctacgtgcccaccctggacgacttcagaagcatggaggccttcagcggcatcttcaagagcccccacggcgaggaccacgacctggccggcgaggaggtggccagctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcctgttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacaagctgaagagcgtgctgagaaagatcaaggaggagttcgagagaaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgagacccccctgaaccccgtgtggaacgacaacgcccacggcgtgggcagcgtgcccatgcacaccgacctggagctggacttcagcctgaccagcagcagcaagtacacctacagaagaaagctgaccaaccccctggaggagagccaggccatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcagcttcaagtgctgccacggcgaggactgcagccagatcggcctgcacgccgccgccccccacctggacaaggtgaacggcatcagcgagatcgagaacagcaaggtgttcgacgacggcgccccccagtgcggcatcaagtgctggttcgtgaagagcggcgagtggatcagcggcatcttcaacggcaactggatcgtgctgatcgtgctgtgcgtgttcctgctgttcagcctggtgctgctgagcatcctgtgccccgtgagaaagcacaagaagagctga

SEQ ID NO: 8441 - RNA, 3405 nt, synthetic construct
  misc_feature 1..3405: note = derived and/or modified CDS sequence (opt4) from HTNV(NC167)__AB027115.2__GP
  source 1..3405: mol_type = other RNA
atgtggggcctgctggtggtggccggcctgatcggcccctgcatcagcctgagaaacgtgtacgacatgaagatcgagtgcccccacaccgtgaacttcggcgagaacagcgtgatcggctacgtggagctgccccccgtgcccatcgccgacatcacccagatggtgcccgagagcagctgcaacatggacaaccaccagagcctgagcaccttcaccaagtacacccagctgatctggagaaagaaggccgagcaggcccaggccagccagaacagcttcgagaccgtgagcagagaggtggacttcaagggcacctgcgtgttcaagcacaagatggtggaggagagctacaagaacagaaagagcatcatctgctacgacctgagctgcaacatcacccactgcaagcccaccctgtacatgatcatccccgtgcacgcctgcaacatgatgaagagctgcctgatcgccctgggccccttcagagtgcaggtggtgtacgagagaacctactgcatgagcggcatcctgaccgagggcagatgcttcgtgccctaccagagcgtggtgagcatcatcaagcacggcatcttcgacatcgccagcatccacatcatctgcttcttcatcgccgtggagggcaacacctacaagctgttcgaggaggtgaagaagagcttcgccctgaactgcaacgacaccgagaacaagatccagggctactacatctgcatcatcggcggcaacagcgcccccgtgtacgcccccagccccgacgacttcagaagcatggaggccttcagcggcatcttcagaagcccccacggcgagaaccacgacctgaacggcggcagaaacgccccctacagcatcgtgggccccaccgacggcaaggtgccccacagcagcaagcactacaacatcgagttcgacagcatcttccagaagttccccacctacagcagcttcagcatcctggccggcagcgtggagcccaagcacgtgttccagcccggcctgttccccaagctgaaccacaccaagtgcaccaagagcgccatccccctggtgtggaccggcagaatcgacatccccggctactacgaggccgtgcaccccctgaccgtgtactgcgagctgagcggccccggcgccagctgcgaggccttcagcgagggcggcatcttcaacatcaccagccccatgtgcctggtgagcaagcagaacagattcagaagcctgagacagcaggtgagcttcgtgtgccagagagtggacatggacatcgtggtgtactgcaacggccagaagaagaccatcctgaccaagaccctggtgatcggccagtgcatctacaccatcaccagcctgttcagcctgctgcccagcgtggcccacagcatcgccgtggagctgtgcgtgcccggcttccacggctgggccaccgccgccctgctgatcaccttctgcttcggctgggtgctgatccccgccctgaccttcatcatcctgaccatcctgaagttcatcgccaacatcttccacaccagcaaccaggagaacaagctgaaggccgtgctgagaaagatcaaggaggagttcgagaagaccaagggcagcatggtgtgcgacatctgcaagtacgagtgcgacacctacaaggagctgaaggcccacggcctgagctgcccccagagccagtgcccctactgcttcacccactgcgagcccaccgagagcgccttccaggcccactacaaggtgtgccaggtgacccacagattcagagaggagctgaagaagaccgtgaccccccagaacttcacccccggctgctacagaaccctgaacctgttcagatacaagagcagatgctacatcttcaccatgtggatcctgctgctggtgttcgagagcatcctgtgggccgccagcgccagcgacgtgcccctgagcaccgactggaacgacaacgcccacggcgtgggcagcgtgcccatgcacaccgacctggagctggacttcagcctgaccagcagcagcaagtacacctacagaagaaagctgaccaaccccgtggacaccagccaggccgtggacctgcacatcgagctggaggagcagaccatcggcctggacgtgcacgccctgggccactggttcgacggcagactgaacctgaagaccagcttccactgctacggcgcctgcaccaagtacgagtacccctggcacaccgccaagtgccacttcgagagagacttccagtacgagaccagctggggctgcaacccccccgactgccccggcgtgggcaccggctgcaccgcctgcggcctgtacatcgaccagctgagacccgtgggcaacgcctacaagatcatcaccatcagatacagcagaaaggtgtgcgtgcagttcggcgacgagaacctgtgcaagaccatcgacatgaacgactgcttcgtgagcaagcacgtgaaggtgtgcatcatcggcaccgtgagcaagttcagccagggcgacaccctgctgttcctgggccccatggagggcggcggcatcatcttcaagcactggtgcaccagcacctgccagttcggcgaccccggcgacatcatgagccccaaggacaagggcttcagctgccccgagttcagcggcagcttcagaaagaagtgcaacttcgccaccacccccgcctgcgagtacggcggcaacatggtgagcggctacagaaaggtgatggccaccatcgacagcttccaggccttcaacaccagcaccatccacttcaccgacgagagaatcgagtggaaggaccccgacggcatgctgagagaccacatcaacatcctggtgaccagagacatcgacttcgacaacctggccgagaacccctgcaagatcggcctgcaggtgagcgccatcgagggcgcctggggcagcggcgtgggcttcaccctgacctgccaggtgagcctgaccgagtgcagcaccttcctgaccagcatcaaggcctgcgacaaggccatctgctacggcgcccagagcgtgaccctggtgagaggccagaacaccgtgaagatcagcggcaagggcggccacagcggcagcgccttcaagtgctgccacggcgaggactgcagccagaccggcctgcaggccgacgccccccacctggacaaggtgaacggcatcagcgaggtggagaacgacaaggtgtacgacgacggcgcccccgagtgcggcatcaagtgctggttcgtgaagagcggcgagtgggtggccggcatcttcagcggcaactggatcgtgctggtggtgctgtgcatcttcctgatcatcagcctgatcctgctgagcatcctgtgccccgtgagaaagcacaagaagagctga

SEQ ID NO: 8442 - RNA, 3408 nt, synthetic construct
  misc_feature 1..3408: note = derived and/or modified CDS sequence (opt4) from HTNV(WuhanAaJ10)__JQ665882.1__GP
  source 1..3408: mol_type = other RNA
atgggcatctggaagtggctggtgatggccagcctggtgtggcccgccttcgccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcctgaacaccatcaccaagtacacccagatcatctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccgccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacaccgtgtgcttcttcgtggccgtgaagggcagcacctacaagctgttcgagcaggccaagaagagcttccagagcaactgcaacgacaccgagaacaaggtgcagggctactacatctgcatcgtgggcggcagcagcgcccccatctacgtgcccaccctggacgacttcagaagcatggaggccttcagcggcctgttcaagagcccccacggcgaggaccacgacctggccggcgaggaggtggccagctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcctgttcccccagctgaaccacaccaagtgcgacaagaccgccatccccctgacctggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcatcgtgtactgcaacggccagagaaaggtgatcctgaccaagaccctggtgatcggccagtgcatctacaccatcaccagcctgatcagcctgctgcccggcgtggcccacagcatcgccgtggagctgtgcgtgcccggcagccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagagaaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgagacccccctgaaccccgtgtggaacgacaacgcccacggcgtgggcagcgtgcccatgcacaccgacctggagctggacttcagcctgaccagcagcagcaagtacacctacagaagaaagctgaccaaccccctggaggagagccaggccatcgacctgcacatcgagatcgaggaccagaccatcggcgtggacgtgcacgccctgggccactggttcgacggcagactgaacctggagaccagcttccactgctacggcgcctgcaccaagtacgagtacccctggcacaccgccaagtgccactacgagagagactaccagtacgagaccagctggggctgcagccccagcgactgccccggcgtgggcaccggctgcaccgcctgcggcctgtacctggaccagctgaagcccgtgggcagcgcctacaagatcatcaccatcagatacagcagaagagtgtgcgtgcagagcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggacagagacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcagcttcaagtgctgccacggcgaggactgcagccagatcggcctgcacgccgccgccccccacctggacaaggtgaacggcatcagcgagatcgagaacagcaaggtgttcgacgacggcgccccccagtgcggcatcaagtgctggagcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8443 - RNA, 3408 nt, synthetic construct
  misc_feature 1..3408: note = derived and/or modified CDS sequence (opt4) from HTNV(Z5)__EU074224.1__GP
  source 1..3408: mol_type = other RNA
atgggcatctggaagtggctggtgatggccagcctggtgtggcccgcctgcaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcaacatggacaaccaccagagcatgaacaccatcaccaagtacacccaggtgagctggagaagcaaggtggaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagggctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacgacaccgagaacaaggtgcagggctactacatctgcatcgtgggcggcaacagcgcccccatctgcgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccggcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcgtgatcctgaccatcctgaagttcatcgccaacatcttccacaccagcaaccagggcaacagactgaagagcgtgctgaagaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccatctggaacgacaacgcccacggcgtgggcagcgtgcccatgcacaccgacctggagctggacttcagcctgaccagcagcagcaagtacacctacagaagaagactgaccaaccccctggaggagacccaggccatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaaggtgggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggccctgctgagcgtgctgtgccccgtgagaagacacaagaagagctga

SEQ ID NO: 8444 - RNA, 3408 nt, synthetic construct
  misc_feature 1..3408: note = derived and/or modified CDS sequence (opt4) from HTNV(ZLS-12)__FJ753399.1__GP
  source 1..3408: mol_type = other RNA
atgggcatctggaagtggctgatcatggccagcctggtgtggcccgcctacaccctgagaaacgtgtacgacatgagaatcgagtgcccccacaccgtgagcttcggcgagaacagcgtgatcggctacgtggagctgccccccatgcccctggccgacaccagccagatggtgcccgagagcagctgcagcatggacaaccaccagagcctgaacaccatcaccaagtacacccaggtgagctggagaggcaaggccgaccagagccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcatcctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacgacaccgaggacaaggtgcagggctactacatctgcatcgccggcggcaacagcgcccccatctacgtgcccaccctggacgacttcagaagcatggaggccttcagcggcatcttcaagagcccccacggcgaggaccacgacctggccggcgaggagatcgccagctacagcatcgtgggccccgccaacgccaaggtgccccacagcgccagcagcgacaccctgagcctgaccgcctacagcggcatccccagctacagcagcctgagcatcctgaccagcagcaccgaggccaagcacgtgttcagccccggcttcttcccccagctgaaccacaccaagtgcgacaagaccgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgaggtgcccctgagccccgtgtggaacgacaacgcccacggcgtgggcagcatccccatgcacaccgacctggagctggacttcagcctgaccagcagcagcaagtacacctacagaagaaagctgaccaaccccctggaggagacccaggccatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaagagtgtgcgtgcagctgggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcaagtggaaggaccccgacggcatgctgagagaccacatcaacatcctggtgaccaaggacatcgacttcgacaacctgggcgagaacccctgcaagatcggcctgcagaccagcgccatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcctgttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8445 - RNA, 3408 nt, synthetic construct
  misc_feature 1..3408: note = derived and/or modified CDS sequence (opt4) from HTNV(ZLS6-11)__FJ753397.1__GP
  source 1..3408: mol_type = other RNA
atgggcatctggaagtggctgatcatggccagcctggtgtggcccgcctacaccctgagaaacgtgtacgacatgagaatcgagtgcccccacaccgtgagcttcggcgagaacagcgtgatcggctacgtggagctgccccccatgcccctggccgacaccagccagatggtgcccgagagcagctgcagcatggacaaccaccagagcctgaacaccatcaccaagtacacccaggtgagctggagaggcaaggccgaccagagccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcatcctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacgacaccgaggacaaggtgcagggctactacatctgcatcgccggcggcaacagcgcccccatctacgtgcccaccctggacgacttcagaagcatggaggccttcagcggcatcttcaagagcccccacggcgaggaccacgacctggccggcgaggagatcgccagctacagcatcgtgggccccgccaacgccaaggtgccccacagcgccagcagcgacaccctgagcctgaccgcctacagcggcatccccagctacagcagcctgagcatcctgaccagcagcaccgaggccaagcacgtgttcagccccggcttcttcccccagctgaaccacaccaagtgcgacaagaccgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgaggtgcccctgagccccgtgtggaacgacaacgcccacggcgtgggcagcatccccatgcacaccgacctggagctggacttcagcctgaccagcagcagcaagtacacctacagaagaaagctgaccaaccccctggaggagacccaggccatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcgccatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcctgttcaagtgctgccacggcgaggagtgcagccagatcggcctgcacgccgccgccccccacctggacaaggtggacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8446 - RNA, 3408 nt, synthetic construct
  misc_feature 1..3408: note = derived and/or modified CDS sequence (opt4) from HTNV__AB030232.1__GP
  source 1..3408: mol_type = other RNA
atgggcctgtggaagtggctgatcatggccgtgctggtgtggccctgcttcgccctgagaaacgtgtacgacatgaagatcgagtgcccccacaccgtgaacttcggcgagaacagcgtggtgggctacgtggagctgccccccatgcccatcgccgacatcacccagatgatgcccgagagcagctgcagcatggacaaccaccagagcctgaacaccatcaccaagtacacccaggtgagctggagaaagaaggccgacagagcccagagcagccagaccagcttcgagaccgtgagcagcgaggtggacttcaagggcacctgcgtgctgaagcacaagatggtggaggacagctacagaagcagaaagagcatcatctgctacgacctgagctgcaacagcaccttctgcaagcccaccctgtacctgatcgtgcccgtgcacgcctgcaacatgatgaagagctgcctgatcgccctgggcccctacagagtgcaggacgtgtacgagagaacctactgcatgagcggcgtgctgctggagggcaagtgcttcgtgcccgacagaagcgtggtgagcatcatcaagcacggcatcttcgacatcgccagcgtgcacatcgtgtgcttcttcgtggccatcaagggcagcacctacaagatcctggagcaggtgaagaagagcttcgagctgacctgcaacgacaccgacaacaagatccagggctactacatctgcctggtgggcggcaacagcgcccccatctacgtgcccaccctggacgacttcagaagcatggaggccttcgccggcatcttcaagagcccccacggcgaggaccacgacctggccggcgaggaggtggccagctacagcatcgtgggccccgccaacgccaaggtgccccacagcgccagcgccgacaccctgagcctggtggccttcagcggcatccccagctacagcagcttcagcgtgctgaccggcagcaccgacgccagacacgtgttcagccccggcttcttcccccagctgaaccagaccagatgcgacaagaccgccatccccctgacctggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcgagcagaacagattcagaagcagcgagcagcaggtgaacttcgtgtgccagagagtggacatggacatcgtggtgtactgcaacggccagaagaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccgtgaccctggtgatcctgaccatcctgaagttcatcgccaacatcttccacaccagcaaccaggagaacagactgaagagcgtgctgaagaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctgatcctggagagcatcctgtgggccgccagcgccagcgagacccccagcacccccatctggaacgacaacgcccacggcgtgggcagcatccccatgcacaccgacctggagctggacttcagcctgaccagcagcagcaagtacacctacagaagaaagctgaccaaccccctggagaagacccaggccgtggacctgcacatcgagctggccgtgcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcaagtacagcagaagagtgtgcgtgcagttcggcgaggagaacctgtgcaaggtgatcgacatgaacgactgcttcgtgagcagacacgtgaagatctgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcttccagagcttcaacaccagcatgatgcacttcaccgacgagagaatcgagtggaaggaccccgacggcatgctgagagaccacatcaacatcctggtgaccaaggacatcgacttcgacaacctgggcgacaacccctgcaaggtgggcctgcagaccagcgccatcgagggcgcctggggcagcggcgtgggcttcaccctgacctgccaggtgagcctgaccgagtgccccaccttcctgaccagcatcaaggcctgcgacaaggccatctgctacggcgccgagagcatcaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatggagaacagcaaggtgtacgacgacggcgcccccgagtgcggcatcaagtgctggttcgtgaagagcggcgagtggatcagcggcatcttcaacggcaactggatcgtgctgatcgtgctgtgcgccttcctgatcttcagcctggtgctgctgagcctgctgtgccccgtgagaaagcacaagaaggcctga

SEQ ID NO: 8447 - RNA, 3408 nt, synthetic construct
  misc_feature 1..3408: note = derived and/or modified CDS sequence (opt4) from HTNV__AB620032.1__GP
  source 1..3408: mol_type = other RNA
atgggcatgtggaagtggctggtgatcgccagcctggtgtggcccgtgctggccctgagaaacgtgtacgacatgaagatcgagtgcccccacaccgtgagcttcggcgagaacagcgtgatcggcttcgtggagctgccccccatgcccctggccgacaccgcccagatggtgcccgagagcagctgcagcatggacaaccaccagagcatcaacaccatcaccaagtacacccaggtgacctggagaggcaaggccgaccccggccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccatcaagggcaacacctacaagctgttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcaagagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctgaccagcagcaccgacgccaagcacgtgttcagccccggcctgttccccaagctgaaccacaccaactgcgacaagagcgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccgtgaccttcgtgatcctgaccatcctgaagttcgtggccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctgatcctggagagcgtgctgtgggccgccagcgccagcgagacccccctggcccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacaccgtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8448 - RNA, 3408 nt, synthetic construct
  misc_feature 1..3408: note = derived and/or modified CDS sequence (opt4) from HTNV__D25532.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcggcaacagcgtgatcggctacgtggagctgccccccgtgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcgtgacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagactgatcgcctacagcggcatccccagctacagcagcctgagcatcctgaccagcagcaccgaggccaagcacgtgttcagccccggcctgttccccaagctgaaccacaccaactgcgacaagagcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagcagcatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgggcatcctgtgccccgtgagaaagcacaagaagagctga

SEQ ID NO: 8449 - RNA, 3408 nt, synthetic construct
  misc_feature 1..3408: note = derived and/or modified CDS sequence (opt4) from HTNV__L08753.1__GP
  source 1..3408: mol_type = other RNA
atgggcatctggaagtggctggtgatggccagcctggtgtggcccgcctacaccctgagaaacgtgtacgacatgaagatcgagtgcccccacaccgtgagcttcggcgagaacagcgtgatcggctacgtggagctgccccccatccccctggccgacaccacccagatggtgcccgagagcagctgcagcatggacaaccaccagagcctgaacaccgtgaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcgcctgctacgacctgagctgcaacagcacctactgcaagcccaccctgtacatgatcgtgcccatccacgcctgcaacatgatgaagagctgcctgatcgccctgggcccccacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcagatcaagaagagcttcgagagcacctacaacgacaccaagaacaaggtggagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgtgaaggtgccccacagcgccagcagcgacaccctgagcctgaccgcctacagcggcatccccagctacagcagcctgagcatcctggccggcagcgccgaggccaagcacgtgttcagccccggcttcttcccccagctgaaccacaccaagtgcgacaagaccgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatgaccttcatcgtgctgaccatcctgaagttcatcgccaacatcttccacaccagcaaccaggagaacaagctgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgagatccccctgtaccccgtgtggaacgacaacgcccacggcgtgggcagcgtgcccatgcacaccgacctggagctggacttcagcctgaccagcagcagcaagtacacctacagaagaaagctgaccaaccccctggaggagagccaggccatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgacagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgagaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggctacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctgatcctgctgagcatcctgtgccccgccagaaagcacaagaagagctga

SEQ ID NO: 8450 - RNA, 3408 nt, synthetic construct
  misc_feature 1..3408: note = derived and/or modified CDS sequence (opt4) from HTNV__M14627.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccgtgcccctggccgacaccgcccagatggtgcccgagagcagctgcaacatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcgtgacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaagctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcctgttccccaagctgaaccacaccaactgcgacaagagcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcagatgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8451 - RNA, 3408 nt, synthetic construct
  misc_feature 1..3408: note = derived and/or modified CDS sequence (opt4) from HTNV__EU074672.1__GP
  source 1..3408: mol_type = other RNA
atgggcatctggaagtggctggtgatggccagcctggtgtggcccgccttcgccctgagaaacgtgtacgacatgaagatcgagtgcccccacaccgtgagcttcggcgagaacagcgtgatcggctacgtggagctgccccccatgcccctggccgacaccacccagatggtgcccgagagcagctgcagcatggacaaccaccagagcctgaacaccatcaccaagtacacccagatcatctggagaggcaaggccgaccagagccagagcagccagaacagcttcgagaccgtgagcaccgaggtggacctgaagggcacctgcgtgctgaagcacaagatgatcgaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcaactgcaacgacaccgagaacaaggtgcagggctactacatctgcatcatcggcggcaacagcagccccgtgtacgtgcccaccctggacgacttcagaagcatggaggccttcagcggcatcttcagaagcccccacggcgaggaccacgacctggccggcgaggaggtggccagctacagcatcgtgggccccgccaacgccaaggtgccccacagcgccagcagcgacaccctgggcctgatcgcctacagcggcatccccagctacagcagcctgagcatcctgaccagcagcaccgaggccaagcacgtgttcagccccggcctgttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagagaaccaagggcagcatggtgtgcgacatctgcaagtacgagtgcgagacctacagagagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgagatccccctgaaccccgtgtggaacgacaacgcccacggcgtgggcagcatccccatgcacaccgacctggagctggacttcagcctgaccagcagcagcaagtacacctacagaagaaagctgaccaaccccctggaggagagccaggccatcgacctgcacgtggagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgcagcaccttcctgaccagcatcaaggcctgcgacaaggccatctgctacggcgccgagagcgtgaccctgaccagaggccagaacaccgtgaaggtgagcggcaagggcggccacagcggcagcagcttcaagtgctgccacggcgaggagtgcagccagatcggcctgcacgccgccgccccccacctggacaaggtgaacggcatcagcgagatggagaacagcaaggtgttcgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8452 - RNA, 3408 nt, synthetic construct
  misc_feature 1..3408: note = derived and/or modified CDS sequence (opt4) from HTNV__GQ120966.1__GP
  source 1..3408: mol_type = other RNA
atggagatctggaagtggctggtgatggccagcctggtgtggcccgccttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcaacatggacaaccaccagagcatgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttccagagcacctgcaacggcaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctggccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccctgaccctgatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgtgcctgctggtgctggagagcatcctgtgggccgccagcgccagcgaggtgcccctgaaccccgtgtggaacgacaacgcccacggcgtgggcagcgtgcccatgcacaccgacctggagctggacttccccctgaccagcagcagcaagtacacctacagaagaagactgaccaaccccctggaggagacccagagcatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccgccgactgccccggcgtgggcaccggctgcaccgcctgcggcctgtacctggaccagctgaagcccgtgggcagcgcctacaagatcatcaccatcagatacagcagaaaggtgtgcgtgcagttcggcgaggagaacctgtgcaaggtgatcgacatgaacgactgcttcgtgaccagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8453 - RNA, 3408 nt, synthetic construct
  misc_feature 1..3408: note = derived and/or modified CDS sequence (opt4) from HTNV(CGAa1011)__EF990927.1__GP
  source 1..3408: mol_type = other RNA
atggagatctggaagtggctggtgatggccagcctggtgtggcccgccctggccctgagaaacgtgcacgacatgaagatcgagtgcccccacaccgtgagcttcggcaagaacagcgtgatcggctacgtggagctgccccccatgcccctggccgacaccatccagatggtgcccgagagcagctgcagcatggacaaccaccagagcctgagcaccgtgaccaagtacacccaggtgagctggagaggcaaggccgaccaggcccagagcaaccagaccagcttcgagaccgtgagcgtggaggtggacctgaagggcacctgcgtgctgaagcacaagctggtggaggagagctacagaagcagaaagagcctgacctgctacgacctgagctgcaacagcacctactgcaagcccaccctgtacatgatcgtgcccatccacgcctgcaacatgatgaagagctgcatcatcgccctgggcccccacagagtgcaggtggtgtacgagagaacctactgcatgaccggcgtgctgctggagggcaagtgcttcgtgcccgaccagagcgtggtgggcatcgtgaagcacggcatcttcgacatcgccagcgtgcacatcgcctgcttcttcgtggccatcaccggcaacacctacaagctgttcgagcaggtgaagaagagcttcggcaccacctgcaacgacaccgagaacaaggtgcagggctactacatctgcatcctgggcggcaacagcccccccatctacgtgcccaccctggacgacttcagaagcatggaggccttcagcggcatcttcaagagcccccacggcgaggaccacgacctggccggcgaggagatcgccagctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttcccccagctgaaccacaccaagtgcgacaagaccgccatccccctgacctggaccggcatcatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctgatcaccttctgcttcggctgggtgctgatccccgccctgaccttcatcgtgctgaccgtgctgaagttcatcgccaacatcttccacaccagcaaccaggagaacagactgaagatggtgctgaagaagatcaaggaggagttcgagagaaccaagggcagcatggtgtgcgacatctgcaagtacgagtgcgagacctacaaggagctgaaggcccacggcgtgagctgcccccagagccagtgcccctactgcttcacccactgcgagcccaccgagagcgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtggatctgcctgctggtgctggagagcatcctgtgggccgccagcgccagcgagatccccctgagccccacctggaacgacaacgcccacggcgtgggcagcatccccatgcacaccgacctggagctggacttcagcctgaccagcagcagcaagtacacctacagaagaaagctgaccaaccccctggaggagagccaggccgtgaacttccacgtggagatcgaggagcaggccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcttccagagcagcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatcgagaacagcaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8454 - RNA, 3408 nt, synthetic construct
  misc_feature 1..3408: note = derived and/or modified CDS sequence (opt4) from HTNV(CGAa2)__EU092223.1__GP
  source 1..3408: mol_type = other RNA
atggagatctggaagtggctggtgatggccagcctggtgtggcccgccctggccctgagaaacgtgcacgacatgaagatcgagtgcccccacaccgtgagcttcggcaagaacagcgtgatcggctacgtggagctgccccccatgcccctggccgacaccatccagatggtgcccgagagcagctgcagcatggacaaccaccagagcctgagcaccgtgaccaagtacacccaggtgagctggagaggcaaggccgaccaggcccagcccagccagaccagcttcgagaccgtgagcgtggaggtggacctgaagggcacctgcgtgctgaagcacaagctggtggaggagagctacagaagcagaaagagcctgacctgctacgacctgagctgcaacagcacctactgcaagcccaccctgtacatgatcgtgcccatccacgcctgcaacatgatgaagagctgcatcatcgccctgggcccccacagagtgcaggtggtgtacgagagaacctactgcatgaccggcgtgctgctggagggcaagtgcttcgtgcccgaccagagcgtggtgagcatcgtgagacacggcatcttcgacatcgccagcgtgcacatcgcctgcttcttcgtggccatcaccggcaacacctacaagctgttcgagcaggtgaagaagagcttcggcaccacctgcaacgacaccgagaacaaggtgcagggctactacatctgcatcctgggcggcaacagcccccccatctacgtgcccaccctggacgacttcagaagcatggaggccttcagcggcatcttcaagagcccccacggcgaggaccacgacctggccggcgaggagatcgccagctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttcccccagctgaaccacaccaagtgcgacaagaccgccatccccctgacctggaccggcatcatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctgatcaccttctgcttcggctgggtgctgatccccgccctgaccttcatcgtgctgaccgtgctgaagttcatcgccaacatcttccacaccagcaaccaggagaacagactgaagatggtgctgaagaagatcaaggaggagttcgagagaaccaagggcagcatggtgtgcgacatctgcaagtacgagtgcgagacctacaaggagctgaaggcccacggcgtgagctgcccccagagccagtgcccctactgcttcacccactgcgagcccaccgagagcgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtggatctgcctgctggtgctggagagcatcctgtgggccgccagcgccagcgagatccccctgagccccacctggaacgacaacgcccacggcgtgggcagcatccccatgcacaccgacctggagctggacttcagcctgaccagcagcagcaagtacacctacagaagaaagctgaccaaccccctggaggagagccaggccgtgaacttccacgtggagatcgaggagcaggccatcggcgtggacgtgcacgccctgggccactggagcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcttccagagcagcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatcgagaacagcaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8455 - RNA, 3408 nt, synthetic construct
  misc_feature 1..3408: note = derived and/or modified CDS sequence (opt4) from HTNV(CGAa31MP7)__EF990925.1__GP
  source 1..3408: mol_type = other RNA
atgggcatctggaagtggctggtgatggccagcctggtgtggcccgccttcgccctgagaaacgtgtacgacatgaagatcgagtgcccccacaccgtgagcttcggcgagaacagcgtgatcggctacgtggagctgccccccatgcccctggccgacaccacccagatggtgcccgagagcagctgcagcatggacaaccaccagagcctgaacaccatcaccaagtacacccagatcatctggagaggcaaggccgaccagagccagagcagccagaacagcttcgagaccgtgagcaccggcgtggacctgaagggcacctgcgtgctgaagcacaagatgatcgaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcaactgcaacgacaccgagaacaaggtgcagggctactacatctgcatcatcggcggcaacagcagccccgtgtacgtgcccaccctggacgacttcagaagcatggaggccttcagcggcatcttcagaagcccccacggcgaggaccacgacctggccggcgaggaggtggccagctacagcatcgtgggccccgccaacgccaaggtgccccacagcgccagcagcgacaccctgggcctgatcgcctacagcggcatccccagctacagcagcctgagcatcctgaccagcagcaccgaggccaagcacgtgttcagccccggcctgttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagagaaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtggatctgcctgctggtgctggagagcatcctgtgggccgccagcgccagcgagatccccctgaaccccgtgtggaacgacaacgcccacggcgtgggcagcatccccatgcacaccgacctggagctggacttcagcctgaccagcagcagcaagcacacctacagaagaaagctgaccaaccccctggaggagagccaggccatcgacctgcacgtggagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcggctacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8456 - RNA, 3408 nt, synthetic construct
  misc_feature 1..3408: note = derived and/or modified CDS sequence (opt4) from HTNV(CGAa4MP9)__EF990929.1__GP
  source 1..3408: mol_type = other RNA
atggagatctggaagtggctggtgatggccagcctggtgtggcccgccctggccctgagaaacgtgtacgacatgaagatcgagtgcccccacaccgtgagcttcggcgagaacagcgtgctgggctacgtggagctgccccccatgcccctggccgacaccatccagatggtgcccgagagcagctgcagcatggacaaccaccagagcatgagcaccgccaccaagtacacccaggtgagctggagaggcaaggccgaccaggcccagagcagccagaccagcttcgagaccgtgagcgtggaggtggacctgaagggcacctgcgtgctgaagcacaagatggtggagaagagctacagaagcagaaagagcctgacctgctacgacctgagctgcaacagcacctactgcaagcccaccctgtacatgatcgtgcccatccacgcctgcaacatgatgaagagctgcatcatcgccctgggcccctacagagtgcaggtggtgtacgagagaacctactgcatgaccggcgtgctgctggagggcaagtgcttcgtgcccgaccagagcgtggtgagcatcgtgaagcacagcatcttcgacatcgccagcgtgcacatcgcctgcttcttcgtggccatcaccggcaacacctacaagctgatcgagcaggtgaagaccagcttcggcaccacctgcaacgacaccgaggacaaggtgcagggctactacatctgcatcctgggcggcaacagcccccccatctacgtgcccaccctggacgacttcagaagcatggaggccttcagcggcatcttcagaagcccccacggcgaggaccacgacctggccggcgaggagatcgccagctacagcatcgtgggccccgccaacgccaagatcccccacagcgccagcagcgacaccctgagcctgatcgccttcagcggcatccccagctacagcagcctgagcatcctgaccagcagcaccgaggccaagcacgtgttcagccccggcctgttcccccagctgaaccacaccaagtgcgacaagaccgccatccccctgacctggaccggcatcatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcgtggtgctgaccgtgctgaagttcatcgccaacatcttccacaccagcaaccaggagaacagactgaagatggtgctgaagaagatcaaggaggagttcgagaagaccaagggcagcatggtgtgcgacatctgcaagtacgagtgcgagacctacaaggagctgaaggcccacggcgtgagctgcccccagagccagtgcccctactgcttcacccactgcgagcccaccgagagcgccttccaggcccactacagagtgtgccaggtgacccacagattcagagaggacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgagccccacctggaacgacaacgcccacggcgtgggcagcatccccatgcacaccgacctggagctggacttcagcctgaccagcagcagcaagtacacctacagaagaaagctgaccaaccccctggaggaggcccaggccgtgagcttccacgtggagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacatggacgactgcttcgtgagcagacacgtgaaggtgtgcatcatcggcaccgtgagcaagttcagccagggcgacaccctgctgttcttcggccccctggagggcggcggcctgatctacaagcactggtgcaccagcacctgccagttcggcgaccccggcgacatcatgagccccagagacaagggcctgctgtgccccgagttccccggcagcttcagaaagaagtgcaacttcgccaccacccccgtgtgcgagtacgacggcaacatggtgagcggctacaagaaggtgatggccaccatcgacagcttccagagcatcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8457 - RNA, 3408 nt, synthetic construct
  misc_feature 1..3408: note = derived and/or modified CDS sequence (opt4) from HTNV(CGAa4P15)__EF990928.1__GP
  source 1..3408: mol_type = other RNA
atggagatctggaagtggctggtgatggccagcctggtgtggcccgccctggccctgagaaacgtgtacgacatgaagatcgagtgcccccacaccgtgagcttcggcgagaacagcgtgctgggctacgtggagctgccccccatgcccctggccgacaccatccagatggtgcccgagagcagctgcagcatggacaaccaccagagcatgagcaccgccaccaagtacacccaggtgagctggagaggcaaggccgaccaggcccagagcagccagaccagcttcgagaccgtgagcgtggaggtggacctgaagggcacctgcgtgctgaagcacaagatggtggagaagagctacagaagcagaaagagcctgacctgctacgacctgagctgcaacagcacctactgcaagcccaccctgtacatgatcgtgcccatccacgcctgcaacatgatgaagagctgcatcatcgccctgggcccctacagagtgcaggtggtgtacgagagaacctactgcatgaccggcgtgctgctggagggcaagtgcttcgtgcccgaccagagcgtggtgagcatcgtgaagcacagcatcttcgacatcgccagcgtgcacatcgcctgcttcttcgtggccatcaccggcaacacctacaagctgttcgagcaggtgaagaccagcttcggcaccacctgcaacgacaccgaggacaaggtgcagggctactacatctgcatcctgggcggcaacagcccccccatctacgtgcccaccctggacgacttcagaagcatggaggccttcagcggcatcttcagaagcccccacggcgaggaccacgacctggccggcgaggagatcgccagctacagcatcgtgggccccgccaacgccaagatcccccacagcgccagcagcgacaccctgagcctgatcgccttcagcggcatccccagctacagcagcctgagcatcctgaccagcagcaccgaggccaagcacgtgttcagccccggcctgttcccccagctgaaccacaccaagtgcgacaagaccgccatccccctgacctggaccggcatcatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcgtggtgctgaccgtgctgaagttcatcgccaacatcttccacaccagcaaccaggagaacagactgaagatggtgctgaagaagatcaaggaggagttcgagaagaccaagggcagcatggtgtgcgacatctgcaagtacgagtgcgagacctacaaggagctgaaggcccacggcgtgagctgcccccagagccagtgcccctactgcttcacccactgcgagcccaccgagagcgccttccaggcccactacagagtgtgccaggtgacccacagattcagagaggacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgagccccacctggaacgacaacgcccacggcgtgggcagcatccccatgcacaccgacctggagctggacttcagcctgaccagcagcagcaagtacacctacagaagaaagctgaccaaccccctggaggaggcccaggccgtgagcttccacgtggagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacatggacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcttccagagcatcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8458 - RNA, 3408 nt, synthetic construct
  misc_feature 1..3408: note = derived and/or modified CDS sequence (opt4) from HTNV(CGAa75)__EU092224.1__GP
  source 1..3408: mol_type = other RNA
atggagatctggaagtggctggtgatggccagcctggtgtggcccgccctggccctgagaaacgtgcacgacatgaagatcgagtgcccccacaccgtgagcttcggcaagaacagcgtgatcggctacgtggagctgccccccatgcccctggccgacaccatccagatggtgcccgagagcagctgcagcatggacaaccaccagagcctgagcaccgtgaccaagcacacccaggtgagctggagaggcaaggccgaccaggcccagagcagccagaccagcttcgagaccgtgagcgtggaggtggacctgaagggcacctgcgtgctgaagcacaagctggtggaggagagctacagaagcagaaagagcctgacctgctacgacctgagctgcaacagcacctactgcaagcccaccctgtacatgatcgtgcccatccacgcctgcaacatgatgaagagctgcatcatcgccctgggcccccacagagtgcaggtggtgtacgagagaacctactgcatgaccggcgtgctgctggagggcaagtgcttcgtgcccgaccagagcgtggtgagcatcgtgagacacggcatcttcgacatcgccagcgtgcacatcgcctgcttcttcgtggccatcaccggcaacacctacaagctgttcgagcaggtgaagaagagcttcggcaccacctgcaacgacaccgagaacaaggtgcagggctactacatctgcatcctgggcggcaacagcccccccatctacgtgcccaccctggacgacttcagaagcatggaggccttcagcggcatcttcaagagcccccacggcgaggaccacgacctggccggcgaggagatcgccagctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttcccccagctgaaccacaccaagtgcgacaagaccgccatccccctgacctggaccggcatcatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctgatcaccttctgcttcggctgggtgctgatccccgccctgaccttcatcgtgctgaccgtgctgaagttcatcgccaacatcttccacaccagcaaccaggagaacagactgaagatggtgctgaagaagatcaaggaggagttcgagagaaccaagggcagcatggtgtgcgacatctgcaagtacgagtgcgagaccaacaaggagctgaaggcccacggcgtgagctgcccccagagccagtgcccctactgcttcacccactgcgagcccaccgagagcgccagccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtggatctgcctgctggtgctggagagcatcctgtgggccgccagcgccagcgagatccccctgagccccacctggaacgacaacgcccacggcgtgggcagcatccccatgcacaccgacctggagctggacttcagcctgaccagcagcagcaagtacacctacagaagaaagctgaccaaccccctggaggagagccaggccgtgaacttccacgtggagatcgaggagcaggccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcatcgtgatcgacatgaacgactgcttcgtgagcagacacgtgaaggtgtgcatcatcggcaccgtgagcaagttcagccagggcgacaccctgctgttcttcggccccctggagggcggcggcctgatcctgaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacggcggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaaggagagctga

SEQ ID NO: 8459 - RNA, 3408 nt, synthetic construct
  misc_feature 1..3408: note = derived and/or modified CDS sequence (opt4) from HTNV(CGHu2)__EU363819.1__GP
  source 1..3408: mol_type = other RNA
atgggcatctggaagtggctggtgatggccagcctggtgtggcccgccttcgccctgagaaacgtgtacgacatgaagatcgagtgcccccacaccgtgagcttcggcgagaacagcgtgatcggctacgtggagctgccccccatgcccctggccgacaccacccagatggtgcccgagagcagctgcagcatggacaaccaccagagcctgaacaccatcaccaagtacacccagatcatctggagaggcaaggccgaccagagccagagcagccagaacagcttcgagaccgtgagcaccggcgtggacctgaagggcacctgcgtgctgaagcacaagatgatcgaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttctacgtggccgtgaagggcaacacctacaagatcttcgagcaggtgaagaagagcttcgagagcaactgcaacgacaccgagaacaaggtgcagggctactacatctgcatcatcggcggcaacagcagccccgtgtacgtgcccaccctggacgacttcagaagcatggaggccttcagcggcatcatcagaagcccccacggcgaggaccacgacctggccggcgaggaggtggccagctacagcatcgtgggccccgccaacgccaaggtgccccacagcgccagcagcgacaccctgggcctgatcgcctacagcggcatccccagctacagcagcctgagcatcctgaccagcagcaccgaggccaagcacgtgttcagccccggcctgttcccccagctgaaccacaccaagtgcgacaagaccgccatccccctgacctggaccggcatgatcgacctgcccggctactacgaggccatccacccctgcaccgtgatctgcgtgctgagcggccccggcgccagctgcgaggccctgagcgagggcggcatcttcaacatcaccagccccatgtgcctggtgagcaagcagaacagattcagactgaccgagcagcaggtgaacttcgtgtgccagagagtggacgtggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagagaaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtggatctgcctgctggtgctggagagcatcctgtgggccgccagcgccagcgagatccccctgaaccccgtgtggaacgacaacgcccacggcgtgggcagcatccccatgcacaccgacctggagctggacttcagcctgaccagcagcagcaagcacacctacagaagaaagctgaccaaccccctggaggagagccaggccatcgacctgcacgtggagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcggctacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8460 - RNA, 3408 nt, synthetic construct
  misc_feature 1..3408: note = derived and/or modified CDS sequence (opt4) from HTNV(CGHu3)__EU363818.1__GP
  source 1..3408: mol_type = other RNA
atggagatctggaagtggctggtgatggccagcctggtgtggcccgccctggccctgagaaacgtgcacgacatgaagatcgagtgcccccacaccgtgagcttcggcaagaacagcgtgatcggctacgtggagctgccccccatgcccctggccgacaccatccagatggtgcccgagagcagctgcagcatggacaaccaccagagcctgagcaccgccaccaagtacacccaggtgagctggagaggcaaggccgaccaggcccagagcagccagaccagcttcgagaccgtgagcgtggaggtggacctgaagggcacctgcgtgctgaagcacaagctggtggaggagagctacagaagcagaaagagcctgacctgctacgacctgagctgcaacagcacctactgcaagcccaccctgtacatgatcgtgcccatccacgcctgcaacatgatgaagagctgcatcatcgccctgggcccccacagagtgcaggtggtgtacgagagaacctactgcatgaccggcgtgctgctggagggcaagtgcttcgtgcccgaccagagcgtggtgagcatcgtgagacacggcatcttcgacatcgccagcgtgcacatcgcctgcttcttcgtggccatcaccggcaacacctacaagctgttcgagcaggtgaagaagagcttcggcaccacctgcaacgacaccgagaacaaggtgcagggctactacatctgcatcctgggcggcaacagcccccccatctacgtgcccaccctggacgacttcagaagcatggaggccttcagcggcatcttcaagagcccccacggcgaggaccacgacctggccggcgaggagatcgccagctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttcccccagctgaaccacaccaagtgcgacaagaccgccatccccctgacctggaccggcatcatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccctgaccagcctgttcagcctgctgcccggcgtggcccacagcatcgccgtggagctgtgcgtgcccggcttccacggctgggccaccgccgccctgctgatcaccttctgcttcggctgggtgctgatccccgccctgaccttcatcgtgctgaccgtgctgaagttcatcgccaacatcttccacaccagcaaccaggagaacagactgaagatggtgctgaagaagatcaaggaggagttcgagagaaccaagggcagcatggtgtgcgacatctgcaagtacgagtgcgagacctacaaggagctgaaggcccacggcgtgagctgcccccagagccagtgcccctactgcttcacccactgcgagcccaccgagagcgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtggatctgcctgctggtgctggagagcatcctgtgggccgccagcgccagcgagatccccctgagccccacctggaacgacaacgcccacggcgtgggcagcatccccatgcacaccgacctggagctggacttcagcctgaccagcagcagcaagtacacctacagaagaaagctgaccaaccccctggaggagagccaggccgtgaacttccacgtggagatcgaggagcaggccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaaggtgggcctgagaaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8461 - RNA, 3408 nt, synthetic construct
  misc_feature 1..3408: note = derived and/or modified CDS sequence (opt4) from HTNV(CGHu3612)__EF990923.1__GP
  source 1..3408: mol_type = other RNA
atgggcatctggaagtggctggtgatggccagcctggtgtggcccgccttcgccctgagaaacctgtacgacatgaagatcgagtgcccccacaccgtgagcttcggcgagaacagcgtgaccggctacgtggagctgccccccatgcccctggccgacaccacccagatggtgcccgagagcagctgcagcatggacaaccaccagagcctgaacaccatcaccaagtacacccagatcatctggagaggcaaggccgaccagagccagagcagccagaacagcttcgagaccgtgagcaccgaggtggacctgaagggcacctgcgtgctgaagcacaagatgatcgaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcatcgtggccgtgaagggcaacacctacaagatcttcgagcaggtgaagaagaccttcgagagcaactgcaacgacaccgagaacaaggtgcagggctactacatctgcatcatcggcggcaacagcagccccgtgtacgtgcccaccctggacgacttcagaagcatggaggccttcagcggcatcatcagaagcccccacggcgaggaccacgacctggccggcgaggaggtggccagctacagcatcgtgggccccgccaacgccaaggtgccccacagcgccagcagcgacaccctgggcctgatcgcctacagcagcatccccagctacagcagcctgagcatcctgaccagcagcaccgaggccaagcacgtgttcagccccggcctgttcagacagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcgccagccccatgtgcctggtgagcaagcagaacagattcagactgaccgagcagcaggtgaacttcgtgtgccagagagtggacgtggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagagaaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgagatccccctgaaccccgtgtggaacgacaacgcccacggcgtgggcagcatccccatgcacaccgacctggagctggacttcagcctgaccagcagcagcaagtacacctacagaagaaagctgaccaaccccctggaggagagccaggccatcgacctgcacgtggagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcatccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgcagcaccttcctgaccagcatcaaggcctgcgacaaggccatctgctacggcgccgagagcgtgaccctgaccagaggccagaacaccgtgaaggtgagcggcaagggcggccacagcggcagcagcttcaagtgctgccacggcgaggagtgcagccagatcggcctgcacgccgccgccccccacctggacaaggtgaacggcatcagcgagatggagaacagcaaggtgttcgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8462 - RNA, 3408 nt, synthetic construct
  misc_feature 1..3408: note = derived and/or modified CDS sequence (opt4) from HTNV(CGHu3614)__EF990922.1__GP
  source 1..3408: mol_type = other RNA
atgggcatctggaagtggctggtgatggccagcctggtgtggcccgccttcgccctgagaaacctgtacgacatgaagatcgagtgcccccacaccgtgagcttcggcgagaacagcgtgaccggctacgtggagctgccccccatgcccctggccgacaccacccagatggtgcccgagagcagctgcagcatggacaaccaccagagcctgaacaccatcaccaagtacacccagatcatctggagaggcaaggccgaccagagccagagcagccagaacagcttcgagaccgtgagcaccgaggtggacctgaagggcacctgcgtgctgaagcacaagatgatcgaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagaccttcgagagcaactgcaacgacaccgagaacaaggtgcagggctactacatctgcatcatcggcggcaacagcagccccgtgtacgtgcccaccctggacgacttcagaagcatggaggccttcagcggcatcttcagaagcccccacggcgaggaccacgacctggccggcgaggaggtggccagctacagcatcgtgggccccgccaacgccaaggtgccccacagcgccagcagcgacaccctgggcctgatcgcctacagcagcatccccagctacagcagcctgagcatcctgaccagcagcaccgaggccaagcacgtgttcagccccggcctgttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcgccagccccatgtgcctggtgagcaagcagaacagattcagactgaccgagcagcaggtgaacttcgtgtgccagagagtggacgtggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagagaaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgagatccccctgaaccccgtgtggaacgacaacgcccacggcgtgggcagcatccccatgcacaccgacctggagctggacttcagcctgaccagcagcagcaagtacacctacagaagaaagctgaccaaccccctggaggagagccaggccatcgacctgcacgtggagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgcagcaccttcctgaccagcatcaaggcctgcgacaaggccatctgctacggcgccgagagcgtgaccctgaccagaggccagaacaccgtgaaggtgagcggcaagggcggccacagcggcagcagcttcaagtgctgccacggcgaggagtgcagccagatcggcctgcacgccgccgccccccacctggacaaggtgaacggcatcagcgagatggagaacagcaaggtgttcgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8463 - RNA, 3408 nt, synthetic construct
  misc_feature 1..3408: note = derived and/or modified CDS sequence (opt4) from HTNV(CGRn15)__EU363814.1__GP
  source 1..3408: mol_type = other RNA
atggagatctggaagtggctggtgatggccagcctggtgtggcccgccctggccctgagaaacgtgcacgacatgaagatcgagtgcccccacaccgtgagcttcggcaagaacagcgtgatcggctacgtggagctgccccccatgcccctggccgacaccatccagatggtgcccgagagcagctgcagcatggacaaccaccagagcctgagcaccgtgaccaagtacacccaggtgagctggagaggcaaggccgaccaggcccagagcagccagaccagcagcgagaccgtgagcgtggaggtggacctgaagggcacctgcgtgctgaagcacaagctggtggaggagagctacagaagcagaaagagcctgacctgctacgacctgagctgcaacagcacctactgcaagcccaccctgtacatgatcgtgcccatccacgcctgcaacatgatgaagagctgcatcatcgccctgggcccccacagagtgcaggtggtgtacgagagaacctactgcatgaccggcgtgctgctggagggcaagtgcttcgtgcccgaccagagcgtggtgagcatcgtgagacacggcatcttcgacatcgccagcgtgcacatcgcctgcttcttcgtggccatcaccggcaacacctacaagctgttcgagcaggtgaagaagagcttcggcaccacctgcaacgacaccgagaacaaggtgcagggctactacatctgcatcctgggcggcaacagcccccccatctacgtgcccaccctggacgacttcagaagcatggaggccttcagcggcatcttcaagagcccccacggcgaggaccacgacctggccggcgaggagatcgccagctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttcccccagctgaaccacaccaagtgcgacaagaccgccatccccctgacctggaccggcatcatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctgatcaccttctgcttcggctgggtgctgatccccgccctgaccttcatcgtgctgaccgtgctgaagttcatcgccaacatcttccacaccagcaaccaggagaacagactgaagatggtgctgaagaagatcaaggaggagttcgagagaaccaagggcagcatggtgtgcgacatctgcaagtacgagtgcgagacctacaaggagctgaaggcccacggcgtgagctgcccccagagccagtgcccctactgcttcacccactgcgagcccaccgagagcgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtggatctgcctgctggtgctggagagcatcctgtgggccgccagcgccagcgagatccccctgagccccacctggaacgacaacgcccacggcgtgggcagcatccccatgcacaccgacctggagctggacttcagcctgaccagcagcagcaagtacacctacagaagaaagctgaccaaccccctggaggagagccaggccgtgaacttccacgtggagatcgaggagcaggccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggcagcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcttccagagcagcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatcgagaacagcaaggtgtacgacgacggcgccccccagtgcggcgtgaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8464 - RNA, 3408 nt, synthetic construct
  misc_feature 1..3408: note = derived and/or modified CDS sequence (opt4) from HTNV(CGRn2616)__EU363816.1__GP
  source 1..3408: mol_type = other RNA
atggagatctggaagtggctggtgatggccagcctggtgtggcccgccctggccctgagaaacgtgcacgacatgaagatcgagtgcccccacaccgtgagcttcggcaagaacagcgtgatcggctacgtggagctgccccccatgcccctggccgacaccatccagatggtgcccgagagcagctgcagcatggacaaccaccagagcctgagcaccgtgaccaagcacacccaggtgagctggagaggcaaggccgaccaggcccagagcagccagaccagcttcgagaccgtgagcgtggaggtggacctgaagggcacctgcgtgctgaagcacaagctggtggaggagagctacagaagcagaaagagcctgacctgctacgacctgagctgcaacagcacctactgcaagcccaccctgtacatgatcgtgcccatccacgcctgcaacatgatgaagagctgcatcatcgccctgggcccccacagagtgcaggtggtgtacgagagaacctactgcatgaccggcgtgctgctggagggcaagtgcttcgtgcccgaccagagcgtggtgagcatcgtgagacacggcatcttcgacatcgccagcgtgcacatcgcctgcttcttcgtggccatcaccggcaacacctacaagctgttcgagcaggtgaagaagagcttcggcaccacctgcaacgacaccgagaacaaggtgcagggctactacatctgcatcctgggcggcaacagcccccccatctacgtgcccaccctggacgacttcagaagcatggaggccttcagcggcatcttcaagagcccccacggcgaggaccacgacctggccggcgaggagatcgccagctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttcccccagctgaaccacaccaagtgcgacaagaccgccatccccctgacctggaccggcatcatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctgatcaccttctgcttcggctgggtgctgatccccgccctgaccttcatcgtgctgaccgtgctgaagttcatcgccaacatcttccacaccagcaaccaggagaacagactgaagatggtgctgaagaagatcaaggaggagttcgagagaaccaagggcagcatggtgtgcgacatctgcaagtacgagtgcgagaccaacaaggagctgaaggcccacggcgtgagctgcccccagagccagtgcccctactgcttcacccactgcgagcccaccgagagcgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtggatctgcctgctggtgctggagagcatcctgtgggccgccagcgccagcgagatccccctgagccccacctggaacgacaacgcccacggcgtgggcagcatccccatgcacaccgacctggagctggacttcagcctgaccagcagcagcaagtacacctacagaagaaagctgaccaaccccctggaggagagccaggccgtgaacttccacgtggagatcgaggagcaggccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcatcgtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacggcggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8465 - RNA, 3408 nt, synthetic construct
  misc_feature 1..3408: note = derived and/or modified CDS sequence (opt4) from HTNV(CGRn2618)__EU363817.1__GP
  source 1..3408: mol_type = other RNA
atggagatctggaagtggctggtgatggccagcctggtgtggcccgccctggccctgagaaacgtgcacgacatgaagatcgagtgcccccacaccgtgagcttcggcaagaacagcgtgatcggctacgtggagctgccccccatgcccctggccgacaccatccagatggtgcccgagagcagctgcagcatggacaaccaccagagcctgagcaccgtgaccaagtacacccaggtgagctggagaggcaaggccgaccaggcccagagcagccagacccccttcgagaccgtgagcgtggaggtggacctgaagagaacctgcgtgctgaagcacaagctggtggaggagagctacagaagcagaaagagcctgacctgctacgacctgagctgcaacagcacctactgcaagcccaccctgtacatgatcgtgcccatccacgcctgcaacatgatgaagagctgcatcatcgccctgggcccccacagagtgcaggtggtgtacgagagaacctactgcatgaccggcgtgctgctggagggcaagtgcttcgtgcccgaccagagcgtggtgagcatcgtgagacacggcatcttcgacatcgccagcgtgcacatcgcctgcttcttcgtggccatcaccggcaacacctacaagctgttcgagcaggtgaagaagagcttcggcaccacctgcaacgacaccgagaacaaggtgcagggctactacatctgcatcctgggcggcaacagcccccccatctacgtgcccaccctggacgacttcagaagcatggaggccttcagcggcatcttcaagagcccccacggcgaggaccacgacctggccggcgaggagatcgccagctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttcccccagctgaaccacaccaagtgcgacaagaccgccatccccctgacctggaccggcatcatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctgatcaccttctgcttcggctgggtgctgatccccgccctgaccttcatcgtgctgaccgtgctgaagttcatcgccaacatcttccacaccagcaaccaggagaacagactgaagatggtgctgaagaagatcaaggaggagttcgagagaaccaagggcagcatggtgtgcgacatctgcaagtacgagtgcgagacctacaaggagctgaaggcccacggcgtgagctgcccccagagccagtgcccctactgcttcacccactgcgagcccaccgagagcgccttccaggcccactacagagtgtgccaggtgacccacagattcagagacgacctgaagaagaccgtgaccccccagaacttcacccccggctgctacagaaccctgaacctgttcagatacaagagcagatgctacatcctgaccatgtggaacctgctgctgatccccggctacagactgtgggccgccagcgccagcgagatccccctgagccccacctggaacgacaacgcccacggcgtgggcagcatccccatgcacaccgacctggagctggacttcagcctgaccagcagcagcaagtacacctacagaagaaagctgaccaaccccctggaggagagccaggccgtgaacttccacgtggagatcgaggagcaggccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcatcgtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacggcggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8466 - RNA, 3408 nt, synthetic construct
  misc_feature 1..3408: note = derived and/or modified CDS sequence (opt4) from HTNV(CGRn45)__EU092225.1__GP
  source 1..3408: mol_type = other RNA
atggagatctggaagtggctggtgatggccagcctggtgtggcccgccctggccctgagaaacgtgcacgacatgaagatcgagtgcccccacaccgtgagcttcggcaagaacagcgtgatcggctacgtggagctgccccccatgcccctggccgacaccatccagatggtgcccgagagcagctgcagcatggacaaccaccagagcctgagcaccgtgaccaagtacacccaggtgagctggagaggcaaggccgaccaggcccagagcagccagaccagcttcgaggccgtgagcgtggaggtggacctgaagggcacctgcgtgctgaagcacaagctggtggaggagagctacagaagcagaaagagcctgacctgctacgacctgagctgcaacagcacctactgcaagcccaccctgtacatgatcgtgcccatccacgcctgcaacatgatgaagagctgcatcatcgccctgggcccccacagagtgcaggtggtgtacgagagaacctactgcatgaccggcgtgctgctggagggcaagtgcttcgtgcccgaccagagcgtggtgagcatcgtgagacacggcatcttcgacatcgccagcgtgcacatcgcctgcttcttcgtggccatcaccggcaacacctacaagctgttcgagcaggtgaagaagagcttcggcaccacctgcaacgacaccgagaacaaggtgcagggctactacatctgcatcctgggcggcaacagcccccccatctacgtgcccaccctggacgacttcagaagcatggaggccttcagcggcatcttcaagagcccccacggcgaggaccacgacctggccggcgaggagatcgccagctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttcccccagctgaaccacaccaagtgcgacaagaccgccatccccctgacctggaccggcatcatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctgatcaccttctgcttcggctgggtgctgatccccgccctgaccttcatcgtgctgaccgtgctgaagttcatcgccaacatcttccacaccagcaaccaggagaacagactgaagatggtgctgaagaagatcaaggaggagttcgagagaaccaagggcagcatggtgtgcgacatctgcaagtacgagtgcgagacctacaaggagctgaaggcccacggcgtgagctgcccccagagccagtgcccctactgcttcacccactgcgagcccaccgagagcgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtggatctgcctgctggtgctggagagcatcctgtgggccgccagcgccagcgagatccccctgagccccacctggaacgacaacgcccacggcgtgggcagcatccccatgcacaccgacctggagctggacttcagcctgaccagcagcagcaagtacacctacagaagaaagctgaccaaccccctggaggagagccaggccgtgaacttccacgtggagatcgaggagcaggccatcggcgtggacgtgcacgccctgggccactggttcgacggcagactgaacctgaagaccagcttccactgctacggcgcctgcaccaagtacgagtacccctggcacaccgccaagtgccactacgagagagaccaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacagaaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8467 - RNA, 3408 nt, synthetic construct
  misc_feature 1..3408: note = derived and/or modified CDS sequence (opt4) from HTNV(CGRn53)__EF990921.1__GP
  source 1..3408: mol_type = other RNA
atgggcatctggaagtggctggtgatggccagcctggtgtggcccgcctacaccctgagaaacgtgtacgacatgaagatcgagtgcccccacaccgtgagcttcggcgagaacagcgtgatcggctacgtggagctgccccccatccccctggccgacaccacccagatggtgcccgagagcagctgcagcatggacaaccaccagagcctgaacaccatcaccaagtacacccaggtgagctggagaggcaaggccggccaggcccaggccagccagaacagcttcgaggccgtgagcgccgaggtggacctgaagggcacctgcgtgctgaagcacaagatgctggaggagagctacagaagcagaaagagcatcgcctgctacgacctgagctgcaacagcacctactgcaagcccaccctgtacatgatcgtgcccatccacgcctgcaacatgatgaagagctgcctgatcgccctgggcccccacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcagatcaagaagagcttcgagagcacctgcaacgacaccaagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgaccgcctacagcggcatccccagctacagcagcctgagcatcctggccggcagcgccgaggccaagcacgtgttcagccccggcttcttcccccagctgaaccacaccaagtgcgacaagaccgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatgaccttcatcgtgctgaccatcctgaagttcatcgccaacatcttccacaccagcaaccaggagaacaagctgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcctgaccatgtggaacctgctgctggtgcccggctacagagcctgggccgccagcgccagcgagatccccctgaaccccgtgtggaacgacaacgcccacggcgtgggcagcgtgcccatgcacaccgacctggagctggacttcagcctgaccagcagcagcaagtacacctacagaagaaagctgaccaaccccctggaggagagccaggccatcaacctgcacatcgagatcgaggagcagaccatcggcgtggacgtgcacgccctgggccactggttcgtgggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgagaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctgatcctgctgagcatcctgtgccccgtgagaaagcacaagaagagctga

SEQ ID NO: 8468 - RNA, 3408 nt, synthetic construct
  misc_feature 1..3408: note = derived and/or modified CDS sequence (opt4) from HTNV(CGRn93MP8)__EF990919.1__GP
  source 1..3408: mol_type = other RNA
atgggcatctggaagtggctggtgaaggccagcctggtgtggcccgcctacaccctgagaaacgtgtacgacatgaagatcgagtgcccccacaccgtgagcttcggcgagaacagcgtgatcggctacgtggagctgccccccatccccctggccgacaccacccacatggtgcccgagagcagctgcagcatggacaaccaccagagcctgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcgcctgctacgacctgagctgcaacagcacctactgcaagcccaccctgtacatgatcgtgcccatccacgcctgcaacatgatgaagagctgcctgatcgccctgggcccccacagagtgcaggtggtgtacgagagaacctactgcatgaccggcttcctgatcgagggcaagtgcttcgtgcccgacagaagcgtggtgagcatcatcaagcacggcatcttcgacatcgccagcgtgcacatcgtgtgcttcttcgtggccgtgaagggcaacacctacaagatcttcgagcagatcaagaagagcttcgagagcacctgcaacgacaccaagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgaccgcctacagcggcatccccagctacagcagcctgagcatcctggccggcagcgccgaggccaagcacgtgttcagccccggcttcctgccccagctgaaccacaccaagtgcgacaagaccgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatgaccttcatcgtgctgaccatcctgaagttcatcgccaacatcttccacaccagcaaccaggagaacaagctgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgagatccccctgaaccccgtgtggaacgacaacgcccacggcgtgggcagcgtgcccatgcacaccgacctggagctggacttcagcctgaccagcagcagcaagtacacctacagaagaaagctgaccaaccccctggaggagagccaggccatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgagaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacaacaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctgatcctgctgagcatcctgtgccccgtgagaaagcacgagaagagctga

SEQ ID NO: 8469 - RNA, 3408 nt, synthetic construct
  misc_feature 1..3408: note = derived and/or modified CDS sequence (opt4) from HTNV(CGRn93P8)__EF990918.1__GP
  source 1..3408: mol_type = other RNA
atgggcatctggaagtggctggtgatggccagcctggtgtggcccgcctacaccctgagaaacgtgtacgacatgaagatcgagtgcccccacaccgtgagcttcggcgagaacagcgtgatcggctacgtggagctgccccccatccccctggccgacaccacccagatggtgcccgagagcagctgcagcatggacaaccaccagagcctgaacaccatcaccaagtacacccaggtgagctggagaggcaaggccgaccaggcccaggccagccagaacagcttcgaggccgtgagcgccgaggtggacctgaagggcacctgcgtgctgaagcacaagatgctggaggagagctacagaagcagaaagagcatcgcctgctacgacctgagctgcaacagcacctactgcaagcccaccctgtacatgatcgtgcccatccacgcctgcaacatgatgaagagctgcctgatcgccctgggcccccacagagtgcaggtggtgtacgagagaacctactgcatgaccggcgtgctgatcgagggcaagtgcttcgtgcccgacagaagcgtggtgagcatcatcaagcacggcatcttcgacatcgccagcgtgcacatcgtgtgcttcttcgtggccgtgaagggcaacaactacaagatcttcgagcagatcaagaagagcttcgagagcacctgcaacgacaccaagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggagatcgccagctacagcatcgtgggccccgccaacgccaaggtgccccacagcgccagcagcgacaccctgagcctgaccgcctacagcggcatccccagctacagcagcctgagcatcctggccggcagcgccgaggccaagcacgtgttcagccccggcttcttcccccagctgaaccacaccaagtgcgacaagaccgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatgaccttcatcgtgctgaccatcctgaagttcatcgccaacatcttccacaccagcaaccaggagaacaagctgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccgtgtgctacagaaccctgaacctgttcagatacaagagcagatgctacatcttcaccatgtgggtgttcctgctggtgctggagagcatcctgtgggccgccagcgccagcgagatccccctgaaccccgtgtggaacgacaacgcccacggcgtgggcagcgtgcccatgcacaccgacctggagctggacttcagcctgaccagcagcagcaagtacacctacagaagaaagctgaccaaccccctggaggagagccaggccatcaacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccatctgcggcctgtacctggaccagctgaagcccgtgggcagcgcctacaagatcatcaccatcagatacagcagaagagtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagagcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8470 - RNA, 3408 nt, synthetic construct
  misc_feature 1..3408: note = derived and/or modified CDS sequence (opt4) from HTNV(CGRni1)__EU363815.1__GP
  source 1..3408: mol_type = other RNA
atgggcatctggaagtggctggtgatggccagcctggtgtggcccgccttcgccctgagaaacctgtacgacatgaagatcgagtgcccccacaccgtgagcttcggcgagaacagcgtgaccggctacgtggagctgccccccatgcccctggccgacaccacccagatggtgcccgagagcagctgcagcatggacaaccaccagagcctgaacaccatcaccaagtacacccagatcatctggagaggcaaggccgaccagagccagagcagccagaacagcttcgagaccgtgagcaccgaggtggacctgaagggcacctgcgtgctgaagcacaagatgatcgaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttctacgtggccgtgaagggcaacacctacaagatcttcgagcaggtgaagaagaccttcgagagcaactgcaacgacaccgagaacaaggtgcagggctactacatctgcatcatcggcggcaacagcagccccgtgtacgtgcccaccctggacgacttcagaagcatggaggccttcagcggcatcatcagaagcccccacggcgaggaccacgacctggccggcgaggaggtggccagctacagcatcgtgggccccgccaacgccaaggtgccccacagcgccagcagcgacaccctgggcctgatcgcctacagcagcatccccagctacagcagcctgagcatcctgaccagcagcaccgaggccaagcacgtgttcagccccggcctgttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcgccagccccatgtgcctggtgagcaagcagaacagattcagactgaccgagcagcaggtgaacttcgtgtgccagagagtggacgtggacatcatcgtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagagaaccatgggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccagacagaacttcacccccggctgctacagaaccctgaacctgttcagatacaagagcagatgctacatcttcaccatgtgggtgttcctgatcgtgctggagagcatcctgtgggccgccagcgccagcgagatccccctgaaccccgtgtggaacgacaacgcccacggcgtgggcagcatccccatgcacaccgacctggagctggacttcagcctgaccagcagcagcaagtacacctacagaagaaagctgaccaaccccctggaggagagccaggccatcgacctgcacgtggagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccgtgtgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctgatcagcctgaccgagtgcagcaccttcctgaccagcatcaaggcctgcgacaaggccatctgctacggcgccgagagcgtgaccctgaccagaggccagaacaccgtgaaggtgagcggcaagggcggccacagcggcagcagcttcaagtgctgccacggcgaggagtgcagccagatcggcctgcacgccgccgccccccacctggacaaggtgaacggcatcagcgagatggagaacagcaaggtgttcgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8471 - RNA, 3408 nt, synthetic construct
  misc_feature 1..3408: note = derived and/or modified CDS sequence (opt4) from HTNV(Aa10-434)__KU207160.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcggcaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagatcagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccatcagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcaggccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8472 - RNA, 3408 nt, synthetic construct
  misc_feature 1..3408: note = derived and/or modified CDS sequence (opt4) from HTNV(Aa10-518)__KU207161.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccaagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcgtggacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8473 - RNA, 3408 nt, synthetic construct
  misc_feature 1..3408: note = derived and/or modified CDS sequence (opt4) from HTNV(Aa13_3)__KX687227.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggtggacaccgtgcagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8474 - RNA, 3408 nt, synthetic construct
  misc_feature 1..3408: note = derived and/or modified CDS sequence (opt4) from HTNV(Aa14_186)__KX687228.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatgatcgaggagagctacagaagcagaaagagcatcacctgctacgacctgagctgcaacaacacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgaggtggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8475 - RNA, 3408 nt, synthetic construct
  misc_feature 1..3408: note = derived and/or modified CDS sequence (opt4) from HTNV(Aa14_234)__KX687230.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaccagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccagctgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgacgagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8476 - RNA, 3408 nt, synthetic construct
  misc_feature 1..3408: note = derived and/or modified CDS sequence (opt4) from HTNV(Aa14_239)__KX687231.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgacgagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8477 - RNA, 3408 nt, synthetic construct
  misc_feature 1..3408: note = derived and/or modified CDS sequence (opt4) from HTNV(Aa14-172)__KU207162.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctgaccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatgatcgaggagagctacagaagcagaaagagcatcacctgctacgacctgagctgcaacaacacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgaggtggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8478 - RNA, 3408 nt, synthetic construct
  misc_feature 1..3408: note = derived and/or modified CDS sequence (opt4) from HTNV(Aa14-175)__KU207163.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgaggtggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8479 - RNA, 3408 nt, synthetic construct
  misc_feature 1..3408: note = derived and/or modified CDS sequence (opt4) from HTNV(Aa14-184)__KU207164.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatgatcgaggagagctacagaagcagaaagagcatcacctgctacgacctgagctgcaacaacacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgaggtggagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8480 - RNA, 3408 nt, synthetic construct
  misc_feature 1..3408: note = derived and/or modified CDS sequence (opt4) from HTNV(LR1)__AF288293.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcggcaacagcgtgatcggctacgtggagctgccccccgtgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcgtgacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggacagagacctggccggcgaggagatcgccagctacagcatcgtgggccccgccaacgccaaggtgccccacagcgccagcagcgacaccctgagactgatcgcctacagcggcatccccagctacagcagcctgagcatcctgaccagcagcaccgaggccaagcacgtgttcagccccggcctgttccccaagctgaaccacaccaactgcgacaagagcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagcagcatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttcagattcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacggcctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcggcaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcccctgccccgtgagaaagcacaagaagagctga

SEQ ID NO: 8481 - RNA, 3408 nt, synthetic construct
  misc_feature 1..3408: note = derived and/or modified CDS sequence (opt4) from HTNV(SN7)__AF288656.1__GP
  source 1..3408: mol_type = other RNA
atgggcgtgtggaagtggctggtgatggccagcctggtgtggcccgcctgcaccctgagaaacgtgtacgacatgaagatcgagtgcccccacaccgtgagcttcggcgagaacagcgtgatcggctacgtggagctgccccccatgcccctggccgacaccacccagctggtgcccgagagcagctgcagcatggacaaccaccagagcctgaacaccatcaccaagtacacccaggtgagctggagaaagaaggccgaccaggcccagagcagccagaacagcttcgagaccgtgagcgtggaggtggacctgaagggcacctgcgtgctgaagcacaagatgatcgaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgaagatcgtgtgcttcttcgtggccgtgaagagaaacacctacaagctgttcgagcaggtgaagaagagcttcgacagcacctgcaacgacaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggaggtggccagctacagcatcgtgggccccgccaacgccaaggtgccccacagcgccagcagcgacaccctgagcctgatcgcctacagcggcatccccagctacagcagcctgagcatcctgaccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccatggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccgtgaccttcatcatcctgaccgtgctgaagttcgtggccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgaggtgcccctgaaccccatctggaacgacaacgcccacggcgtgggcagcgtgcccatgcacaccgacctggagctggacttcagcctgaccagcagcagcaagtacacctacagaagaaagctgaccaaccccctggaggagacccaggccatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatgatcagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagaccggcctgcacgccgccgccccccacctggacaaggtgaacggcatcagcgagagcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8482 - RNA, 3408 nt, synthetic construct
  misc_feature 1..3408: note = derived and/or modified CDS sequence (opt4) from HTNV(84FLi)__AF366569.1__GP
  source 1..3408: mol_type = other RNA
atgggcgtgtggaagtggctggtgatggccagcctggtgtggcccgcctgcaccctgagaaacgtgtacgacatgaagatcgagtgcccccacaccgtgagcttcggcgagaacagcgtgatcggctacgtggagctgccccccatgcccctggccgacaccacccagctggtgcccgagagcagctgcagcatggacaaccaccagagcctgaacaccatcaccaagtacacccaggtgagctggagaaagaaggccgaccaggcccagagcagccagaacagcttcgagaccgtgagcgtggaggtggacctgaagggcacctgcgtgctgaagcacaagatgatcgaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgaagatcgtgtgcttcttcgtggccgtgaagggcaacacctacaagctgttcgagcaggtgaagaagagcttcgacagcacctgcaacgacaccgagaacaaggtgcagggctactacatctgcatcgtgggcggcaacagcgcccccatctacgtgcccaccctggacgacttcagaagcatggaggccttcagcggcatcttcagaagcccccacggcgaggaccacgacctggccggcgaggaggtggccagctacagcatcgtgggccccgccaacgccaaggtgccccacaacgccagcagcgacaccctgagcctgatcgcctacagcggcatccccagctacagcagcctgagcatcctgaccagcagcaccgaggccaagcacgtgttcagccccggcttcttcccccagctgaaccacaccaagtgcgacaagaccgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccaagcagcaggtgaacttcgtgtgccagagagtggacatggacatcgtggtgtactgcaacggccagagaaaggtgatcctgaccaagaccatggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccgtgaccttcatcatcctgaccgtgctgaagttcgtggccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacagagtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctggtgctggagagcatcctgtgggccgccagcgccagcgaggtgcccctgaaccccatctggaacgacaacgcccacggcgtgggcagcgtgcccatgcacaccgacctggagctggacttcagcctgaccagcagcagcaagtacacctacagaagaaagctgaccaaccccctggaggagacccaggccatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaaggtgatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccctgtgcgagtacgacggcaacatgatcagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagaccggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcgtgctgtgccccgtgagaaagcacaagaagagctga

SEQ ID NO: 8483 - RNA, 3408 nt, synthetic construct
  misc_feature 1..3408: note = derived and/or modified CDS sequence (opt4) from HTNV(Aa08-1111)__KY594715.1__GP
  source 1..3408: mol_type = other RNA
atgggcatctggaagtggctggtgatggccagcctggtgtggcccgtgttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgcccccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcatcaccagcagcaccgaggccaagcacgtgttcagccccggcctgttccccaagctgaaccacaccaactgcaacaagggcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcggcctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagcacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8484 - RNA, 3408 nt, synthetic construct
  misc_feature 1..3408: note = derived and/or modified CDS sequence (opt4) from HTNV(Aa09-189)__KY594716.1__GP
  source 1..3408: mol_type = other RNA
atgggcatctggaagtggctggtgatggccagcctggtgtggcccgtgttcaccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgcccccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcatcaccagcagcaccgaggccaagcacgtgttcagccccggcctgttccccaagctgaaccacaccaactgcgacaagggcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacatctgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcggcctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagcacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggagtgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8485 - RNA, 3408 nt, synthetic construct
  misc_feature 1..3408: note = derived and/or modified CDS sequence (opt4) from HTNV(CJilin93)__AY748307.1__GP
  source 1..3408: mol_type = other RNA
atgggcatgtggaagtggctggtgatcgccagcctggtgtggcccgccctggccctgagaaacgtgtacgacatgaagatcgagtgcccccacaccgtgagcttcggcgagaacagcgtgatcggctacgtggagctgccccccatgcccctggccgacaccgcccagatggtgcccgagagcagctgcagcatggacaaccaccagagcatcaacaccatcaccaagtacacccaggtgacctggagaggcaaggccgaccccggccagagcagccagaacagcttcgagaccctgagcgccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagctgttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcaagagcccccacggcgaggaccacgacctggccggcgaggagatcgccagctacagcatcgtgggccccgccaacgccaaggtgccccacagcgccagcagcgacaccctgagcctgatcgcctacagcggcatccccagctacagcagcctgagcatcctgaccagcagcaccgacgccaagcacgtgttcagccccggcctgttccccaagctgaaccacaccaactgcgacaagagcgccatccccctgacctggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgacctactgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtgggtgttcctgctgatcctggagagcgtgctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacatcaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagcaagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8486 - RNA, 3408 nt, synthetic construct
  misc_feature 1..3408: note = derived and/or modified CDS sequence (opt4) from HTNV(KHF,clone:4)__LC209208.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccaagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccgtgaccttcatcatcctggccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcatccccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccccaacggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8487 - RNA, 3408 nt, synthetic construct
  misc_feature 1..3408: note = derived and/or modified CDS sequence (opt4) from HTNV(KHF,clone:5)__LC209209.1__GP
  source 1..3408: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacctgcccggctactacgaggccatccacccctgcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccgtgaccttcatcatcctggccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcatccccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccccaacggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8488 - RNA, 3405 nt, synthetic construct
  misc_feature 1..3405: note = derived and/or modified CDS sequence (opt4) from HTNV__D00376.1__GP
  source 1..3405: mol_type = other RNA
atgggcatctggaagtggctggtgatggccagcctggtgtggcccgtgctgaccctgagaaacgtgtacgacatgaagatcgagtgcccccacaccgtgagcttcggcgagaacagcgtgatcggctacgtggagctgccccccatgcccctggccgacaccgcccagctggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcatcacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagaccgccacctacagcatcgtgggccccgccaacgccaaggtgccccacagcgccagcagcgacaccctgagcctgatcgccttcagcggcatccccagctacagcagcctgagcatcctgaccagcagcaccgaggccaagcacgtgttcagccccggcctgttccccaagctgaaccacaccaactgcgacaagggcgccatccccctgatgtggaccggcatgatcgacgtgcccagatactacgacggcatccaccccttcaccgtgttctgcgtgctgagcggccccggcgccagctgcgaggccttcagcgagggcggcatcttcaacatcaccagccccatgtgcctggtgagcaagcagaacagattcagactgaccgagcagcaggtgaacttcgtgtgccagagagtggacgtggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccgtgaccttcatcatcctggccatcctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcatccccatgcacaccgacctggagctggacttcagcctgaccagcagcagcaagtacacctacagaagaaagctgaccaaccccctggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggctgcggcaccggctgcaccgcctgcggcctgtacctggacagactgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggagaaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccccaacggcctgcacgccgccgccccccacctggacaaggtgaacggcatcagcgagatcgagaacagcaaggagtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 8489 - RNA, 3417 nt, synthetic construct
  misc_feature 1..3417: note = derived and/or modified CDS sequence (opt4) from LANV(510B)__AF005728.1__GP
  source 1..3417: mol_type = other RNA
atggagggctggctgttcaccatcctgggcgtgtgctacatcatgaccaccgtgctgcccaagaccatctacgagctgaagatggagtgcccccacaccgtgggcctgggccagggctacatcatcggcagcgccgagctgggcctgatcgacatcgccaccgtgcccgagatcaagctggagagcagctgcaacttcgacctgcacaccaccagcagcacccagaagagcttcacccagctggagtggagaaagaaggccgagaccaccgacaccacccaggccgccagcaccaccttcgaggcccagaccaagaccgtgaacatcagaggcacctgcatcctggccagcgacctgtacgacaccctgaagagagtgaagaagaccgtgctgtgctacgacctgacctgcaaccagacccagtgccagcccaccgtgtacctgatcacccccgtgggcacctgcatgagcatcagaagctgcatggccaacctgctgagcaacagaatccagatcaccttcgagaagacccactgcgtgaccggccagctggtggagggccagtgcttcaaccccagccacagcctgaccctgagccagcccccccacacctacgacgtggtgaccctgcccaccacctgcttcttcaccgccaagaaggccgaccagtacaagatcgtgaagaccttcgagggcatcatcagcaagaccggctgcaccgagaacagcatccagggctactacgtgtgcttcatcggcagccacagcgagcccctgatcatccccaccctggaggacatcagaagcgccgagctggccagcagaatgctgctgcaccccagaggcgaggaccacgaccccctgcagaacgcccaggccgtgctgagaatcgtgggccccatcaccgccaaggtgcccagcagcagcagcaccgagaccctgcagggcatcgccttcgccggcgtgcccatgtacagcagcttcagcaccctggtgagaaacgccgaccccgagtacgtgttcagccccggcatcatccccgagagcaaccagagcgtgtgcgacaagaagaccctgcccctgacctggaccggctacctgcccatcagcggcgagatggagaaggtgaccggctgcaccgtgttctgcaccctggccggccccggcgccaactgcgaggcctacagcgagagcggcatcttcaacatcagcagccccacctgcctggtgaacaaggtgcagagattcagaggcagcgagcagaagatcaacttcatgtgccagagaatcgacaacaacgtggtggtgtactgcaacggccagaagaaggtgatcctgaccaagaccctggtgatcggccagtgcatctacaccttcaccagcctgttcagcctgatgcccgacgtggcccacagcctggccgtggagctgtgcgtgcccggcctgcacggctgggccaccatcgccctgctgagcaccttctgcttcggctggctgctgatccccggcatcaccctgatcgtgctgaagatcctgaagatcctgacctacagctgcagccactacagcagcgagagcaagttcaagatgatcctggagaaggtgaaggtggagtaccagaagaccatgggcagcatggtgtgcgacatctgccaccacgagtgcgagaccgtgaaggagctggagagccacaagcagagctgcgtggagggccagtgcccctactgcatgaccgtgaccgaggccacccagagcgccctgcaggcccacttcagcatctgcaagctgaccggcagattccacgaggccctgaagaagagcctgaagaagcccgaggtgcacagaggctgctacagaaccctgggcgtgttcagatacagaagcagatgctacgtgggcctggtgtggggctgcctgctgaccatcgagctggtgctgtgggccgccagcgccgagacccccctgctggagcccggctggagcgacaccgcccacggcgtgggcgagctgcccctgaagaccgacctggagctggacttcagcctgcccagcagcagcagctacagctacagaagaagactgaccaaccccgccaacaaggaggagagcctgcccttccacttccagatggagaagcaggtgatccacgccgagatccagagcctgggccactggatggacgccaccttcaacatcaagaccgccttccactgctacggcgcctgcaagcagtacagctacccctggcagaccgccaagtgcttcttcgagaaggactaccagtacgagaccggctggggctgcaaccccggcgactgccccggcgtgggcaccggctgcaccgcctgcggcatctacctggacaagctgaagagcgtgggcaaggcctacaaggtgatcagcctgaagtacaccagaaaggtgtgcatccagctgggcaccgagcaggtgtgcaagcacatcgacgccaacgactgcctggtgacccccagcgtgaaggtgtgcatcatcggcaccgtgagcaagatccagcccagcgacaccctgctgttcctgggccccctggagcagggcggcgtgatcctgaagcagtggtgcaccaccagctgcaccttcggcgaccccggcgacatcatgagcaccaccagcggcatgagatgccccgagcacaccggcagcttcagaaagatctgcggcttcgccaccacccccgtgtgcgagtaccagggcaacaccatcagcggctaccagagactgatggccaccaaggacagcttccagagcttcaacctgaccgacccccacatcaccagcagcaagctggagtggatcgaccccgacggcaacaccagagaccacgtgaacctgatcctgaacagagacgtgagcttccaggacctgagcgacaacccctgcaaggtggacctgcacacccagagcatcgacggcgcctggggcagcggcgtgggcttcaccctgacctgcgtggtgggcctgaccgagtgccccagcttcatcaccagcatcaaggcctgcgacctggccatgtgctacggcagcaccgtggccaccctggccagaggcagcaacaccgtgaaggtggtgggcaagggcggccacagcggcagcagcttcaagtgctgccacgacagcgactgcagcagcgagggcctgatggccagcgccccccacctggagagagtgaccggcttcaaccagatcgacagcgacaaggtgtacgacgacggcgcccccccctgcagcttcaagtgctggttcaccaagagcggcgagtggctgctgggcatcctgaacggcaactggatcgtgatcgccgtgctggtgatcatcctgatcatcagcatcatcctgttcagcttcctgtgccccagaagaagccacaagaagaacgtgtga

SEQ ID NO: 8490 - RNA, 3402 nt, synthetic construct
  misc_feature 1..3402: note = derived and/or modified CDS sequence (opt4) from LQUV(Longquan-Rs-32)__JX465402.1__GP
  source 1..3402: mol_type = other RNA
atgaagagcatcctgctgatcctgctgctggagcaggtgagaagcaaggccaccaacgagatcaagctggagtgcccccacgaccagagagtggagaccggcttcagccacggcttcaccgacctgagccccatcctgtacaccaagggcctgttcaccaagcacctggagaacaactgccccttcgacatcagcatcatcaacagactggtgagagacgtgagaatcagcacctggcaggccaagagcaccaacaccgacgccaccgtggccagcgccaccagcttcgagaccaaggacaccgacgacaagctggccggcgtgtgcggcttcttcgacgacatcaccaagcccaagcagggccagagaaaggccatcatctgctacgacctgagctgcaaccagacccactgcctgcccaccctgcacctgatcttcccccagcagttctgccagagcctgaagcagtgcagcatcaacgcctacgaccacaagatcctgatcaccatcagcctgagcttctgccccgagggcctgatcatcggcggcaactgcatcgtgcccgtgctggcccagagccagctgctgcacaaccacatgacctacaacatcaaggtgacctgcttcttcgagtacagcatggccagagagagcctggacaacaagttcctggaggagatgaacagactggtgctgggcagaaactgcgagaagaccgagtacctgggcggctacgtgtgcttcctggccggctacggcaccgccatccacgtgccctacgacaacacctacctgagcggcgccgtggtgaacagcatgaaggccaacctgcacggcgaggaccacgacagactgaagctgggcgacaccagcgccgtgatcgccggcaacctgaagttcgtgatcgacagcaccgcccccgagaagagctaccagggcgagtgcttcaccggccacatgggctacaccagcctgtacttctaccccgtgagaagcaagggcaagtacgtgaccatcctgaccaagggcgtgatccccgtgatcaacaagaccacctgcatgcccaagatcgtgcccctggtgtggaccggcatggtggagatgagaggcatcgaggagaagctggaggcctgcaccatgcactgcatcatggtgggcaacggcgccacctgcgaggccttcagcgccaccggcatcttcgacatcaagagcaccacctgccagatcggcaagacccacaagtacagaagaaccgaggaccagatcaccttcacctgccaggacctgaacaaggacatcagcgtgatctgcaacggcgagaacatcaccgtgcccgtgaagagcctgatcgtgggccagtgcatctacaccatcaccagcatcttcagcatcttccccgccaccgcccacagcatcgccaccgagatgtgcgtgcagggcatccacggctggctgaccatcatcatcttcttcaccttctgcttcggctggctgctgatccccatcctgacctgcctgatcatcaacaccatcgcctacagcctgatcaccctggcctacttcaagaacggcgccagactgggcaacctgatcaagagaatgaagagcgagttccagagaaccatcggcaacaccacctgcaacatctgcctgagagagtgcgagagcgagagcgagtacaagagccacgaggagctgtgcaagaacggcagctgcccctactgcatgaaggacatcggcgtgagccaggtgctgctgaacgagcactacaacgcctgcatgctgatcgacagatacgagaagagactgacccacaccctgaaccagacccccctgtacagcagaaaggtgagaaagatccagagcttcagatacagaaacagatgcttcatcctgaccgtgtggatcatcctgctgaccgtggagagcctgatctgggccagcagcgccgaggacatcaagcccgcccccaagtggcagaacaccgcccacggcatcggcaccatcaagctgaacagcgactacgagctggacttcagcgtggtggccggcagcgagttcacccacaagagaatgctgcagagccccgagagcggcaagaagaacatccccttcaccgtgtacctgagcgagcagctgatcaccagcaccgtgcagatcctgggcaactggatggacgccgagatcaacgtgaagagcgtgttccactgctacggcacctgcaagaagtacagctacccctggcagagcagcccctgccacaaggaggtggacttcgagttccagagcagctggggctgcaaccccatcagctgccccggcatcaacagcggctgcaccgcctgcggcacctacgtggacaagctgaagaccatcgccaaggcctacagaatcatcaccgtgaagtacagcagaaaggtgtgctaccagatcggcaccaagaaggcctgcaagaccctggagagcaacgactgcctggtgagcaacggcgtgaagatctgcgccatcggcaccatcagcaccctgcagaccggcatgaccctggtgttcttcggccccctgaacggcggcgccctgctgatcaaggactggtgcatcagcagctgcaagttcggcgaccccggcgacatcatgcagatcagcaacaacatcacctgccccagcttcgacggcaccatgcagagagtgtgcagattcggcctggagcccatgtgcagctacagcggcaacaagatcagcggcgtgaagagagtgctggagaccaaggacagctacctgagcgtgaacctgaccaagcccaagctggtgggcagcaccctgctgtggaacagcctggacagcagcatcaaggaccacatcaacatcgtggtgagcaacgacatcgacttcgaggacctggccgagaccccctgcaaggtgaccatcaagaacctgaagatcgagggcgcctggggcagcggcatcggcatcaagctgcactgcgaggtgagcctgagcgagtgcagcgagtacctgaccaccatcaaggtgtgcgacaacgccatctgctacggcggcaacgtggcccacctgagcagaggcctgaacaccgtgatcatcaagggcgccggcggccacagcggcagcagcttcaagtgctgccacgagaccagctgcagcgacatcggcttcaaggccgaggccccccacctggccagaatcgtggacgacggcatcaccaccagcatgagctacagcgacggcgcccccgaggccggcatcgtgagctggatctacaaggtggccgagtggatcaagggcatgttcaacggcaactggttcgtgctgatcatcatgatcctgttcctgatcatcagcatcgtgctgctgatcttcctgtgccccgtgaagaagtacaagtga

SEQ ID NO: 8491 - RNA, 3402 nt, synthetic construct
  misc_feature 1..3402: note = derived and/or modified CDS sequence (opt4) from LQUV(Longquan-Ra-25)__JX465397.1__GP
  source 1..3402: mol_type = other RNA
atgaagagcatcctgctgatcctgctgctgggccaggtgagaagcaaggccaccaacgagatcaagctggagtgcccccacgaccagagagtggagaccggcttcagccacggcttcaccgacctgagccccatcctgtacaccaagggcctgttcaccaagcacctggagaacaactgccccttcgacatcagcatcatcaacagactggtgagagacgtgagaatcagcacctggcaggccaagagcaccaacaccgacgccaccgtggccagcgccaccagcttcgagaccaaggacaccgacgacaagctggccggcgtgtgcggcttcttcgacgacatcaccaagcccaagcagggccagagaaaggccatcatctgctacgacctgagctgcaaccagacccactgcctgcccaccctgcacctgatcttcccccagcagttctgccagagcctgaagcagtgcagcatcaacgcctacgaccacaagatcctgatcaccatcagcctgagcttctgccccgagggcctgatcatcggcggcaactgcatcgtgcccgtgctggcccagagccagctgctgcacaaccacatgacctacaacatcaaggtgacctgcttcttcgagtacagcatggccagagagagcctggacaacaagttcctggaggagatgaacagactggtgctgggcagaaactgcgagaagaccgagtacctgggcggctacgtgtgcttcctggccggctacggcaccgccatccacgtgccctacgacaacacctacctgagcggcgccgtggtgaacagcatgaaggccaacctgcacggcgaggaccacgacagactgaagctgggcgacaccagcgccgtgatcgccggcaacctgaagttcgtgatcgacagcaccgcccccgagaagagctaccagggcgagtgcttcaccggccacatgggctacaccagcctgtacttctaccccgtgagaagcaagggcaagtacgtgaccatcctgaccaagggcgtgatccccgtgatcaacaagaccacctgcatgcccaagatcgtgcccctggtgtggaccggcatggtggagatgagaggcatcgaggagaagctggaggcctgcaccatgcactgcatcatggtgggcaacggcgccacctgcgaggccttcagcgccaccggcatcttcgacatcaagagcaccacctgccagatcggcaagacccacaagtacagaagaaccgaggaccagatcaccttcacctgccaggacctgaacaaggacatcagcgtgatctgcaacggcgagaacatcaccgtgcccgtgaagagcctgatcgtgggccagtgcatctacaccatcaccagcatcttcagcatcttccccgccaccgcccacagcatcgccaccgagatgtgcgtgcagggcatccacggctggctgaccatcatcatcttcttcaccttctgcttcggctggctgctgatccccatcctgacctgcctgatcatcaacaccatcgcctacagcctgatcaccctggcctacttcaagaacggcgccagactgggcaacctgatcaagagaatgaagagcgagttccagagaaccatcggcaacaccacctgcaacatctgcctgagagagtgcgagagcgagagcgagtacaagagccacgaggagctgtgcaagaacggcagctgcccctactgcatgaaggacatcggcgtgagccaggtgctgctgaacgagcactacaacgcctgcatgctgatcgacagatacgagaagagactgacccacaccctgaaccagacccccctgtacagcagaaaggtgagaaagatccagagcttcagatacagaaacagatgcttcatcctgaccgtgtggatcatcctgctgaccgtggagagcctgatctgggccagcagcgccgaggacatcaagcccgcccccaagtggcagaacaccgcccacggcatcggcaccatcaagctgaacagcgactacgagctggacttcagcgtggtggccggcagcgagttcacccacaagagaatgctgcagagccccgagagcggcaagaagaacatccccttcaccgtgtacctgagcgagcagctgatcaccagcaccgtgcagatcctgggcaactggatggacgccgagatcaacgtgaagagcgtgttccactgctacggcacctgcaagaagtacagctacccctggcagagcagcccctgccacaaggaggtggacttcgagttccagagcagctggggctgcaaccccatcagctgccccggcatcaacagcggctgcaccgcctgcggcacctacgtggacaagctgaagaccatcgccaaggcctacagaatcatcaccgtgaagtacagcagaaaggtgtgctaccagatcggcaccaagaaggcctgcaagaccctggagagcaacgactgcctggtgagcaacggcgtgaagatctgcgccatcggcaccatcagcaccctgcagaccggcatgaccctggtgttcttcggccccctgaacggcggcgccctgctgatcaaggactggtgcatcagcagctgcaagttcggcgaccccggcgacatcatgcagatcagcaacaacatcacctgccccagcttcgacggcaccatgcagagagtgtgcagattcggcctggagcccatgtgcagctacagcggcaacaagatcagcggcgtgaagagagtgctggagaccaaggacagctacctgagcgtgaacctgaccaagcccaagctggtgggcagcaccctgctgtggaacagcctggacagcagcatcaaggaccacatcaacatcgtggtgagcaacgacatcgacttcgaggacctggccgagaccccctgcaaggtgaccatcaagaacctgaagatcgagggcgcctggggcagcggcatcggcatcaagctgcactgcgaggtgagcctgagcgagtgcagcgagtacctgaccaccatcaaggtgtgcgacaacgccatctgctacggcggcaacgtggcccacctgagcagaggcctgaacaccgtgatcatcaagggcgccggcggccacagcggcagcagcttcaagtgctgccacgagaccagctgcagcgacatcggcttcaaggccgaggccccccacctggccagaatcgtggacgacggcatcaccaccagcatgagctacagcgacggcgcccccgaggccggcatcatcagctggatctacaaggtggccgagtggatcaagggcatgttcaacggcaactggttcgtgctgatcatcatgatcctgttcctgatcatcagcatcgtgctgctgatcttcctgtgccccgtgaagaagtacaagtga

SEQ ID NO: 8492 - RNA, 3402 nt, synthetic construct
  misc_feature 1..3402: note = derived and/or modified CDS sequence (opt4) from LQUV(Longquan-Ra-5)__JX465398.1__GP
  source 1..3402: mol_type = other RNA
atgaagagcatcctgctgatcctgctgctgggccaggtgagaagcaaggccaccaacgagatcaagctggagtgcccccacgaccagagagtggagaccggcttcagccacggcttcaccgacctgagccccatcctgtacaccaagggcctgttcaccaagcacctggagaacaactgccccttcgacatcagcatcatcaacagactggtgagagacgtgagaatcagcacctggcaggccaagagcaccaacaccgacgccaccgtggccagcgccaccagcttcgagaccaaggacaccgacgacaagctggccggcgtgtgcggcttcttcgacgacatcaccaagcccaagcagggccagagaaaggccatcatctgctacgacctgagctgcaaccagacccactgcctgcccaccctgcacctgatcttcccccagcagttctgccagagcctgaagcagtgcagcatcaacgcctacgaccacaagatcctgatcaccatcagcctgagcttctgccccgagggcctgatcatcggcggcaactgcatcgtgcccgtgctggcccagagccagctgctgcacaaccacatgacctacaacatcaaggtgacctgcttcttcgagtacagcatggccagagagagcctggacaacaagttcctggaggagatgaacagactggtgctgggcagaaactgcgagaagaccgagtacctgggcggctacgtgtgcttcctggccggctacggcaccgccatccacgtgccctacgacaacacctacctgagcggcgccgtggtgaacagcatgaaggccaacctgcacggcgaggaccacgacagactgaagctgggcgacaccagcgccgtgatcgccggcaacctgaagttcgtgatcgacagcaccgcccccgagaagagctaccagggcgagtgcttcaccggccacatgggctacaccagcctgtacttctaccccgtgagaagcaagggcaagtacgtgaccatcctgaccaagggcgtgatccccgtgatcaacaagaccacctgcatgcccaagatcgtgcccctggtgtggaccggcatggtggagatgagaggcatcgaggagaagctggaggcctgcaccatgcactgcatcatggtgggcaacggcgccacctgcgaggccttcagcgccaccggcatcttcgacatcaagagcaccacctgccagatcggcaagacccacaagtacagaagaaccgaggaccagatcaccttcacctgccaggacctgaacaaggacatcggcgtgatctgcaacggcgagaacatcaccgtgcccgtgaagagcctgatcgtgggccagtgcatctacaccatcaccagcatcttcagcatcttccccgccaccgcccacagcatcgccaccgagatgtgcgtgcagggcatccacggctggctgaccatcatcatcttcttcaccttctgcttcggctggctgctgatccccatcctgacctgcctgatcatcaacaccatcgcctacagcctgatcaccctggcctacttcaagaacggcgccagactgggcaacctgatcaagagaatgaagagcgagttccagagaaccatcggcaacaccacctgcaacatctgcctgagagagtgcgagagcgagagcgagtacaagagccacgaggagctgtgcaagaacggcagctgcccctactgcatgaaggacatcggcgtgagccaggtgctgctgaacgagcactacaacgcctgcatgctgatcgacagatacgagaagagactgacccacaccctgaaccagacccccctgtacagcagaaaggtgagaaagatccagagcttcagatacagaaacagatgcttcatcctgaccgtgtggatcaccctgctgaccgtggagagcctgatctgggccagcagcgccgaggacatcaagcccgcccccaagtggcagaacaccgcccacggcatcggcaccatcaagctgaacagcgactacgagctggacttcagcgtggtggccggcagcgagttcacccacaagagaatgctgcagagccccgagagcggcaagaagaacatccccttcaccgtgtacctgagcgagcagctgatcaccagcaccgtgcagatcctgggcaactggatggacgccgagatcaacgtgaagagcgtgttccactgctacggcacctgcaagaagtacagctacccctggcagagcagcccctgccacaaggaggtggacttcgagttccagagcagctggggctgcaaccccatcagctgccccggcatcaacagcggctgcaccgcctgcggcacctacgtggacaagctgaagaccatcgccaaggcctacagaatcatcaccgtgaagtacagcagaaaggtgtgctaccagatcggcaccaagaaggcctgcaagaccctggagagcaacgactgcctggtgagcaacggcgtgaagatctgcgccatcggcaccatcagcaccctgcagaccggcatgaccctggtgttcttcggccccctgaacggcggcgccctgctgatcaaggactggtgcatcagcagctgcaagttcggcgaccccggcgacatcatgcagatcagcaacaacatcacctgccccagcttcgacggcaccatgcagagagtgtgcagattcggcctggagcccatgtgcagctacagcggcaacaagatcagcggcgtgaagagagtgctggagaccaaggacagctacctgagcgtgaacctgaccaagcccaagctggtgggcagcaccctgctgtggaacagcctggacagcagcatcaaggaccacatcaacatcgtggtgagcaacgacatcgacttcgaggacctggccgagaccccctgcaaggtgaccatcaagaacctgaagatcgagggcgcctggggcagcggcatcggcatcaagctgcactgcgaggtgagcctgagcgagtgcagcgagtacctgaccaccatcaaggtgtgcgacaacgccatctgctacggcggcaacgtggcccacctgagcagaggcctgaacaccgtgatcatcaagggcgccggcggccacagcggcagcagcttcaagtgctgccacgagaccagctgcagcgacatcggcttcaaggccgaggccccccacctggccagaatcgtggacgacggcatcaccaccagcatgagctacagcgacggcgcccccgaggccggcatcgtgagctggatctacaaggtggccgagtggatcaagggcatgttcaacggcaactggttcgtgctgatcatcatgatcctgttcctgatcatcagcatcgtgctgctgatcttcctgtgccccgtgaagaagtacaagtga

SEQ ID NO: 8493 - RNA, 3402 nt, synthetic construct
  misc_feature 1..3402: note = derived and/or modified CDS sequence (opt4) from LQUV(Longquan-Ra-56)__JX465399.1__GP
  source 1..3402: mol_type = other RNA
atgaagagcatcctgctgatcctgctgctgggccaggtgagaagcaaggccaccaacgagatcaagctggagtgcccccacgaccagagagtggagaccggcttcagccacggcttcaccgacctgagccccatcctgtacaccaagggcctgttcaccaagcacctggagaacaactgccccttcgacatcagcatcatcaacagactggtgagagacgtgagaatcagcacctggcaggccaagagcaccaacaccgacgccaccgtggccagcgccaccagcttcgagaccaaggacaccgacgacaagctggccggcgtgtgcggcttcttcgacgacatcaccaagcccaagcagggccagagaaaggccatcatctgctacgacctgagctgcaaccagacccactgcctgcccaccctgcacctgatcttcccccagcagttctgccagagcctgaagcagtgcagcatcaacgcctacgaccacaagatcctgatcaccatcagcctgagcttctgccccgagggcctgatcatcggcggcaactgcatcgtgcccgtgctggcccagagccagctgctgcacaaccacatgacctacaacatcaaggtgacctgcttcttcgagtacagcatggccagagagagcctggacaacaagttcctggaggagatgaacagactggtgctgggcagaaactgcgagaagaccgagtacctgggcggctacgtgtgcttcctggccggctacggcaccgccatccacgtgccctacgacaacacctacctgagcggcgccgtggtgaacagcatgaaggccaacctgcacggcgaggaccacgacagactgaagctgggcgacaccagcgccgtgatcgccggcaacctgaagttcgtgatcgacagcaccgcccccgagaagagctaccagggcgagtgcttcaccggccacatgggctacaccagcctgtacttctaccccgtgagaagcaagggcaagtacgtgaccatcctgaccaagggcgtgatccccgtgatcaacaagaccacctgcatgcccaagatcgtgcccctggtgtggaccggcatggtggagatgagaggcatcgaggagaagctggaggcctgcaccatgcactgcatcatggtgggcaacggcgccacctgcgaggccttcagcgccaccggcatcttcgacatcaagagcaccacctgccagatcggcaagacccacaagtacagaagaaccgaggaccagatcaccttcacctgccaggacctgaacaaggacatcagcgtgatctgcaacggcgagaacatcaccgtgcccgtgaagagcctgatcgtgggccagtgcatctacaccatcagcagcatcttcagcatcttccccgccaccgcccacagcatcgccaccgagatgtgcgtgcagagcatccacggctggctgaccatcatcatcttcttcaccttctgcttcggctggctgctgatccccatcctgacctgcctgatcatcaacaccatcgcctacagcctgatcaccctggcctacttcaagaacggcgccagactgggcaacctgatcaagagaatgaagagcgagttccagagaaccatcggcaacaccacctgcaacatctgcctgagagagtgcgagagcgagagcgagtacaagagccacgaggagctgtgcaagaacggcagctgcccctactgcatgaaggacatcggcgtgagccaggtgctgctgaacgagcactacaacgcctgcatgctgatcgacagatacgagaagagactgacccacaccctgaaccagacccccctgtacagcagaaaggtgagaaagatccagagcttcagatacagaaacagatgcttcatcctgaccgtgtggatcatcctgctgaccgtggagagcctgatctgggccagcagcgccgaggacatcaagcccgcccccaagtggcagaacaccgcccacggcatcggcaccatcaagctgaacagcgactacgagctggacttcagcgtggtggccggcagcgagttcacccacaagagaatgctgcagagccccgagagcggcaagaagaacatccccttcaccgtgtacctgagcgagcagctgatcaccagcaccgtgcagatcctgggcaactggatggacgccgagatcaacgtgaagagcgtgttccactgctacggcacctgcaagaagtacagctacccctggcagagcagcccctgccacaaggaggtggacttcgagttccagagcagctggggctgcaaccccatcagctgccccggcatcaacagcggctgcaccgcctgcggcacctacgtggacaagctgaagaccatcgccaaggcctacagaatcatcaccgtgaagtacagcagaaaggtgtgctaccagatcggcaccaagaaggcctgcaagaccctggagagcaacgactgcctggtgagcaacggcgtgaagatctgcgccatcggcaccatcagcaccctgcagaccggcatgaccctggtgttcttcggccccctgaacggcggcgccctgctgatcaaggactggtgcatcagcagctgcaagttcggcgaccccggcgacatcatgcagatcagcaacaacatcacctgccccagcttcgacggcaccatgcagagagtgtgcagattcggcctggagcccatgtgcagctacagcggcaacaagatcagcggcgtgaagagagtgctggagaccaaggacagctacctgagcgtgaacctgaccaagcccaagctggtgggcagcaccctgctgtggaacagcctggacagcagcatcaaggaccacatcaacatcgtggtgagcaacgacatcgacttcgaggacctggccgagaccccctgcaaggtgaccatcaagaacctgaagatcgagggcgcctggggcagcggcatcggcatcaagctgcactgcgaggtgagcctgagcgagtgcagcaagtacctgaccaccatcaaggtgtgcgacaacgccatctgctacggcggcaacgtggcccacctgagcagaggcctgaacaccgtgatcatcaagggcgccggcggccacagcggcagcagcttcaagtgctgccacgagaccagctgcagcgacatcggcttcaaggccgaggccccccacctggccagaatcgtggacgacggcatcaccaccagcatgagctacagcgacggcgcccccgaggccggcatcgtgagctggatctacaaggtggccgagtggatcaagggcatgttcaacggcaactggttcgtgctgatcatcatgatcctgttcctgatcatcagcatcgtgctgctgatcttcctgtgccccgtgaagaagtacaagtga

SEQ ID NO: 8494 - RNA, 3402 nt, synthetic construct
  misc_feature 1..3402: note = derived and/or modified CDS sequence (opt4) from LQUV(Longquan-Ra-90)__JX465400.1__GP
  source 1..3402: mol_type = other RNA
atgaagagcatcctgctgatcctgctgctgggccaggtgagaagcaaggccaccaacgagatcaagctggagtgcccccacgaccagagagtggagaccggcttcagccacggcttcaccgacctgagccccatcctgtacaccaagggcctgttcaccaagcacctggagaacaactgccccttcgacatcagcatcatcaacagactggtgagagacgtgagaatcagcacctggcaggccaagagcaccaacaccgacgccaccgtggccagcgccaccagcttcgagaccaaggacaccgacgacaagctggccggcgtgtgcggcttcttcgacgacatcaccaagcccaagcagggccagagaaaggccatcatctgctacgacctgagctgcaaccagacccactgcctgcccaccctgcacctgatcttcccccagcagttctgccagagcctgaagcagtgcagcatcaacgcctacgaccacaagatcctgatcaccatcagcctgagcttctgccccgagggcctgatcatcggcggcaactgcatcgtgcccgtgctggcccagagccagctgctgcacaaccacatgacctacaacatcaaggtgacctgcttcttcgagtacagcatggccagagagagcctggacaacaagttcctggaggagatgaacagactggtgctgggcagaaactgcgagaagaccgagtacctgggcggctacgtgtgcttcctggccggctacggcaccgccatccacgtgccctacgacaacacctacctgagcggcgccgtggtgaacagcatgaaggccaacctgcacggcgaggaccacgacagactgaagctgggcgacaccagcgccgtgatcgccggcaacctgaagttcgtgatcgacagcaccgcccccgagaagagctaccagggcgagtgcttcaccggccacatgggctacaccagcctgtacttctaccccgtgagaagcaagggcaagtacgtgaccatcctgaccaagggcgtgatccccgtgatcaacaagaccacctgcatgcccaagatcgtgcccctggtgtggaccggcatggtggagatgagaggcatcgaggagaagctggaggcctgcaccatgcactgcatcatggtgggcaacggcgccacctgcgaggccttcagcgccaccggcatcttcgacatcaagagcaccacctgccagatcggcaagacccacaagtacagaagaaccgaggaccagatcaccttcacctgccaggacctgaacaaggacatcagcgtgatctgcaacggcgagaacatcaccgtgcccgtgaagagcctgatcgtgggccagtgcatctacaccatcaccagcatcttcagcatcttccccgccaccgcccacagcatcgccaccgagatgtgcgtgcagggcatccacggctggctgaccatcatcatcttcttcaccttctgcttcggctggctgctgatccccatcctgacctgcctgatcatcaacaccatcgcctacagcctgatcaccctggcctacttcaagaacggcgccagactgggcaacctgatcaagagaatgaagagcgagttccagagaaccatcggcaacaccacctgcaacatctgcctgagagagtgcgagagcgagagcgagtacaagagccacgaggagctgtgcaagaacggcagctgcccctactgcatgaaggacatcggcgtgagccaggtgctgctgaacgagcactacaacgcctgcatgctgatcgacagatacgagaagagactgacccacaccctgaaccagacccccctgtacagcagaaaggtgagaaagatccagagcttcagatacagaaacagatgcttcatcctgaccgtgtggatcatcctgctgaccgtggagagcctgatctgggccagcagcgccgaggacatcaagcccgcccccaagtggcagaacaccgcccacggcatcggcaccatcaagctgaacagcgactacgagctggacttcagcgtggtggccggcagcgagttcacccacaagagaatgctgcagagccccgagagcggcaagaagaacatccccttcaccgtgtacctgagcgagcagctgatcaccagcaccgtgcagatcctgggcaactggatggacgccgagatcaacgtgaagagcgtgttccactgctacggcacctgcaagaagtacagctacccctggcagagcagcccctgccacaaggaggtggacttcgagttccagagcagctggggctgcaaccccatcagctgccccggcatcaacagcggctgcaccgcctgcggcacctacgtggacaagctgaagaccatcgccaaggcctacagaatcatcaccgtgaagtacagcagaaaggtgtgctaccagatcggcaccaagaaggcctgcaagaccctggagagcaacgactgcctggtgagcaacggcgtgaagatctgcgccatcggcaccatcagcaccctgcagaccggcatgaccctggtgttcttcggccccctgaacggcggcgccctgctgatcaaggactggtgcatcagcagctgcaagttcggcgaccccggcgacatcatgcagatcagcaacaacatcacctgccccagcttcgacggcaccatgcagagagtgtgcagattcggcctggagcccatgtgcagctacagcggcaacaagatcagcggcgtgaagagagtgctggagaccaaggacagctacctgagcgtgaacctgaccaagcccaagctggtgggcagcaccctgctgtggaacagcctggacagcagcatcaaggaccacatcaacatcgtggtgagcaacgacatcgacttcgaggacctggccgagaccccctgcaaggtgaccatcaagaacctgaagatcgagggcgcctggggcagcggcatcggcatcaagctgcactgcgaggtgagcctgagcgagtgcagcgagtacctgaccaccatcaaggtgtgcgacaacgccatctgctacggcggcaacgtggcccacctgagcagaggcctgaacaccgtgatcatcaagggcgccggcggccacagcggcagcagcttcaagtgctgccacgagaccagctgcagcgacatcggcttcaaggccgaggccccccacctggccagaatcgtggacgacggcatcaccaccagcatgagctacagcgacggcgcccccgaggccggcatcgtgagctggatctacaaggtggccgagtggatcaagggcatgttcaacggcaactggttcgtgctgatcatcatgatcctgttcctgatcatcagcatcgtgctgctgatcttcctgtgccccgtgaagaagtacaagtga

SEQ ID NO: 8495 - RNA, 3423 nt, synthetic construct
  misc_feature 1..3423: note = derived and/or modified CDS sequence (opt4) from NYV(Rhode Island-1 (RI-1))__U36801.1__GP
  source 1..3423: mol_type = other RNA
atggtgggctgggtgtgcatcttcctggtggtgctggccaccaccaccgccggcctgaccagaaacctgtacgagctgaagatcgagtgcccccacaccgtgggcctgggccagggctacgtgaccggcagcgtggagaccacccccatcctgctgacccaggtgaccgacctgaagatcgagagcagctgcaacttcgacctgcacgtgcccagcaccagcatccagaagtacaaccaggtggagtgggccaagaagagcagcaccaccgagagcaccagcgccggcgccaccaccttcgaggccaagaccaaggaggtgagcctgaagggcacctgcaacatccccgtgaccaccttcgaggccgcctacaagagcagaaagaccgtgatctgctacgacctggcctgcaaccagacctactgcctgcccaccgtgcacctgatcgcccccgtgcagacctgcatgagcgtgagaagctgcatgatcggcctgctgagcagcagaatccaggtgatctacgagaagacctactgcgtgaccggccagctggtggagggcctgtgcttcatccccacccacaccatcgccctgacccagcccggccacacctacgacaccatgaccctgcccatcacctgcttcctggtggccaagaagctgggcacccagctgaagatcgccgtggagctggagaagctgatcaccgccagcggctgcaccgagaacagcttccagggctactacatctgcttcctgggcaagcacagcgagcccctgagcgtgcccatgatggacgactacagaagcgccgagctgttcaccagaatggtgctgaaccccagaggcgaggaccacgaccccgaccagaacggccagggcctgatgagaatcgccggccccatcaccgccaaggtgcccagcaccgagaccaccgagaccatgcagggcatcgccttcgccggcgcccccacctacagcagcttcagcaccctggtgagaaaggccgaccccgactacgtgttcagccccggcatcatcgccgagagcaaccacagcgtgtgcgacaagaaggccatccccctgacctggaccggcttcctggccgtgagcggcgagatcgagaagatcaccggctgcaccgtgttctgcaccctggtgggccccggcgccagctgcaaggcctacagcgagaccggcatcttcaacatcagcagccccacctgcctggtgaacaaggtgcagaagttcagaggcagcgagcagagaatcaacttcatgtgccagagagtggaccaggacgtgatcgtgtactgcaacggccagaagaaggtgatcctgaccaagaccctgatcatcggccagtgcatctacaccttcaccagcctgttcagcctgatccccggcgtggcccacagcctggccgtggagctgtgcgtgcccggcctgcacggctgggccaccgccgccctgctgatcaccttctgcttcggctggctgctgatccccaccatcaccatgatcatcctgaagatcctgagactgctgaccttcagctgcagccactacagcaccgagagcaagttcaaggccatcctggagagagtgaaggtggagtaccagaagaccatgggcagcatggtgtgcgacgcctgccaccacgagtgcgagaccgccaaggagctggagacccacaagaagagctgccccgagggccagtgcccctactgcatgaccatgaccgagagcaccgagagcgccctgctggcccacttcagcatctgcaagctgaccaacagattccaggagaacctgaagaagagcctgaagagacccgaggtgaagcagggcagatacagaaccctgggcgtgttcagatacaagagcagatgctacgtgggcctggtgtggggcgtgctgctgaccaccgagctgatcgtgtgggccgccagcgccgacacccccctgatggagagcggctggagcgacaccgcccacggcgtgggcatcgtgcccatgaagaccgacctggagctggacttcgccctggccagcagcagcagctacagctacagaagaaagctggtgaaccccgccaacaaggaggagaccctgcccttccacttccagctggacaagcaggtggtgcacgccgagatccagaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctgcaccgcctgcggcgtgtacctggacaagctgagaagcggcggcaaggcctacaagatcgtgagcctgaagttcaccagaaaggtgtgcatccagctgggcaccgagcagacctgcaagcacatcgacgtgaacgactgcctggtgacccccagcgtgaaggtgtgcctgatcggcaccatcagcaagctgcagcccggcgacaccctgctgttcctgggccccctggagcagggcggcatcatcctgaagcagtggtgcaccaccagctgcgtgttcggcgaccccggcgacatcatgagcaccaccaccggcatgaagtgccccgagcacaccggcagcttcagaaagatctgcggcttcgccaccacccccacctgcgagtaccagggcaacaccatcagcggcttccagagaatgatggccaccagagacagcttccagagcttcaacgtgaccgagccccacatcaccagcaacagactggagtggatcgaccccgacagcagcatcaaggaccacatcaacatggtgctgaacagagacgtgagcttccaggacctgagcgacaacccctgcaaggtggacctgcacacccagagcatcgacggcgcctggggcagcggcgtgggcttcaccctggtgtgcaccgtgggcctgaccgagtgcgccaacttcatcaccagcatcaaggcctgcgacagcgccatgtgctacggcgccaccgtgaccaacctgctgagaggcagcaacaccgtgaaggtggtgggcaagggcggccacagcagcagcctgttcaagtgctgccacgacaccgactgcaccgaggagggcctggccgccagccccccccacctggacagagtgaccggctacaaccagatcgacagcgacaaggtgtacgacgacggcgcccccccctgcaccatcaagtgctggttcaccaagagcggcgagtggctgctgggcatcctgaacggcaactgggtggtggtggccgtgctgatcgtgatcctgatcctgagcatcctgctgttcagcttcttctgccccatcagaggcagaaagaacaagagcaactga

SEQ ID NO: 8496 - RNA, 3423 nt, synthetic construct
  misc_feature 1..3423: note = derived and/or modified CDS sequence (opt4) from NYV(New York-1 (NY-1))__U36802.1__GP
  source 1..3423: mol_type = other RNA
atggtgggctgggtgtgcatcagcctggtggtgctggccaccaccaccgccggcctgaccagaaacctgtacgagctgaagatcgagtgcccccacaccgtgggcctgggccagggctacgtgaccggcagcgtggagaccacccccatcctgctgacccaggtgaccgacctgaagatcgagagcagctgcaacttcgacctgcacgtgcccagcaccagcatccagaagtacaaccaggtggagtgggccaagaagagcagcaccaccgagagcaccagcgccggcgccaccaccttcgaggccaagaccaaggaggtgagcctgaagggcacctgcaacatccccgtgaccaccttcgaggccgcctacaagagcagaaagaccgtgatctgctacgacctggcctgcaaccagacccactgcctgcccaccgtgcacctgatcgcccccgtgcagacctgcatgagcgtgagaagctgcatgatcggcctgctgagcagcagaatccaggtgatctacgagaagacctactgcgtgaccggccagctggtggagggcctgtgcttcatccccacccacaccatcgccctgacccagcccggccacacctacgacaccatgaccctgcccatcacctgcttcctggtggccaagaagctgggcacccagctgaagatcgccgtggagctggagaagctgatcaccgccagcggctgcaccgagaacagcttccagggctactacatctgcttcctgggcaagcacagcgagcccctgttcgtgcccatgatggacgactacagaagcgccgagctgttcaccagaatggtgctgaaccccagaggcgaggaccacgaccccgaccagaacggccagggcctgatgagaatcgccggccccatcaccgccaaggtgcccagcaccgagaccaccgagaccatgcagggcatcgccttcgccggcgcccccatgtacagcagcttcagcaccctggtgagaaaggccgaccccgactacgtgttcagccccggcatcatcgccgagagcaaccacagcgtgtgcgacaagaagaccatccccctgacctggaccggcttcctggccgtgagcggcgagatcgagaagatcaccggctgcaccgtgttctgcaccctggtgggccccggcgccagctgcgaggcctacagcgagaccggcatcttcaacatcagcagccccacctgcctggtgaacaaggtgcagaagttcagaggcagcgagcagagaatcaacttcatgtgccagagagtggaccaggacgtgatcgtgtactgcaacggccagaagaaggtgatcctgaccaagaccctggtgatcggccagtgcatctacaccttcaccagcctgttcagcctgatccccggcgtggcccacagcctggccgtggagctgtgcgtgcccggcctgcacggctgggccaccaccgccctgctgatcaccttctgcttcggctggctgctgatccccaccatcaccatgatcatcctgaagatcctgagactgctgaccttcagctgcagccactacagcaccgagagcaagttcaaggccatcctggagagagtgaaggtggagtaccagaagaccatgggcagcatggtgtgcgacgtgtgccaccacgagtgcgagaccgccaaggagctggagacccacaagaagagctgccccgagggccagtgcccctactgcatgaccatgaccgagagcaccgagagcgccctgcaggcccacttcagcatctgcaagctgaccaacagattccaggagaacctgaagaagagcctgaagagacccgaggtgaagcagggctgctacagaaccctgggcgtgttcagatacaagagcagatgctacgtgggcctggtgtggggcgtgctgctgaccaccgagctgatcgtgtgggccgccagcgccgacacccccctgatggagagcggctggagcgacaccgcccacggcgtgggcatcgtgcccatgaagaccgacctggagctggacttcgccctggccagcagcagcagctacagctacagaagaaagctggtgaaccccgccaacaaggaggagaccctgcccttccacttccagctggacaagcaggtggtgcacgccgagatccagaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctgcaccgcctgcggcgtgtacctggacaagctgagaagcgtgggcaaggcctacaagatcgtgagcctgaagttcaccagaaaggtgtgcatccagctgggcaccgagcagacctgcaagcacatcgacgtgaacgactgcctggtgacccccagcgtgaaggtgtgcctgatcggcaccatcagcaagctgcagcccggcgacaccctgctgttcctgggccccctggagcagggcggcatcatcctgaagcagtggtgcaccaccagctgcgtgttcggcgaccccggcgacatcatgagcaccaccaccggcatgaagtgccccgagcacaccggcagcttcagaaagatctgcggcttcgccaccacccccacctgcgagtaccagggcaacaccatcagcggcttccagagaatgatggccaccagagacagcttccagagcttcaacgtgaccgagccccacatcaccagcaacagactggagtggatcgaccccgacagcagcatcaaggaccacatcaacatggtgctgaacagagacgtgagcttccaggacctgagcgacaacccctgcaaggtggacctgcacacccagagcatcgacggcgcctggggcagcggcgtgggcttcaccctggtgtgcaccgtgggcctgaccgagtgcgccaacttcatcaccagcatcaaggcctgcgacagcgccatgtgctacggcgccaccgtgaccaacctgctgagaggcagcaacaccgtgaaggtggtgggcaagggcggccacagcggcagcctgttcaagtgctgccacgacaccgactgcaccgaggagggcctggccgccagccccccccacctggacagagtgaccggctacaaccagatcgacagcgacaaggtgtacgacgacggcgcccccccctgcaccatcaagtgctggttcaccaagagcggcgagtggctgctgggcatcctgaacggcaactgggtggtggtggccgtgctgatcgtgatcctgatcctgagcatcctgctgttcagcttcttctgccccatcagaggcagaaagaacaagagcaactga

SEQ ID NO: 8497 - RNA, 3423 nt, synthetic construct
  misc_feature 1..3423: note = derived and/or modified CDS sequence (opt4) from NYV(New York-2 (NY-2))__U36803.1__GP
  source 1..3423: mol_type = other RNA
atggtgggcttcgtgtgcatcttcctggtggtgctggccaccaccaccgccggcctgaccagaaacctgtacgagctgaagatcgagtgcccccacaccgtgggcctgggccagggctacgtgaccggcagcgtgggcaccacccccatcctgctgacccaggtgaccgacctgaagatcgagagcagctgcaacttcgacctgcacgtgcccagcaccagcatccagaagtacaaccaggtggagtgggccaagaagagcagcaccaccgagagcaccagcgccggcgccaccaccttcgaggccaagaccaaggaggtgagcctgaagggcacctgcaacatccccgtgaccaccttcgaggccgcctacaagagcagaaagaccgtgatctgctacgacctggcctgcaaccagacccactgcctgcccaccgtgcacctgatcgcccccgtgcagacctgcatgagcgtgagaagctgcatgatcggcctgctgagcagcagaatccaggtgatctacgagaagacctactgcgtgaccggccagctggtggagggcctgtgcttcatccccacccacaccatcgccctgacccagcccggccacacctacgacaccatgaccctgcccatcacctgcttcctggtggccaagaagctgggcacccagctgaagatcgccgtggagctggagaagctgatcaccgccggcggctgcaccgagaacagcttccagggctactacatctgcttcctgggcaagcacagcgagcccctgttcgtgcccatgatggacgactacagaagcgccgagctgttcaccagaatggtgctgaaccccagaggcgaggaccacgaccccgaccagaacggccagggcctgatgagaatcgccggccccatcaccgccaaggtgcccagcaccgagaccaccgaggccatgcagggcatcgccttcgccggcgcccccatgtacagcagcttcagcaccctggtgagaaaggccgaccccgactacgtgttcagccccggcatcatcgccgagagcaaccacagcgtgtgcgacaagaagaccatccccctgacctggaccggcttcctggccgtgagcggcgagatcgagaagatcaccggctgcaccgtgttctgcaccctggtgggccccggcgccagctgcgaggcctacagcgagaccggcatcttcaacatcagcagccccacctgcctggtgaacaaggtgcagaagttcagaggcagcgagcagagaatcaacttcatgtgccagagagtggaccaggacgtgatcgtgtactgcaacggccagaagaaggtgatcctgaccaagaccctggtgatcggccagtgcatctacaccttcaccagcctgttcagcctgatccccggcgtggcccacagcctggccgtggagctgtgcgtgcccggcctgcacggctgggccaccaccgccctgctgatcaccttctgcttcggctggctgctgatccccaccatcaccatgatcatcctgaagatcctgagactgctgaccttcagctgcagccactacagcaccgagagcaagttcaaggccatcctggagagagtgaaggtggagtaccagaagaccatgggcagcatggtgtgcgacgtgtgccaccacgagtgcgagaccgccaaggagctggagacccacaagaagagctgccccgagggccagtgcccctactgcatgaccatgaccgagagcaccgagagcgccctgcaggcccacttcagcatctgcaagctgaccaacagattccaggagaacctgaagaagagcctgaagagacccgaggtgaagcagggctgctacagaaccctgggcgtgttcagatacaagagcagatgctacgtgggcctggtgtggggcgtgctgctgaccaccgagctgatcgtgtgggccgccagcgccgacacccccctgatggagagcggctggagcgacaccgcccacggcgtgggcatcgtgcccatgaagaccgacctggagctggacttcgccctggccagcagcagcagctacagctacagaagaaagctggtggaccccgccaacaaggaggagaccctgcccttccacttccagctggacaagcaggtggtgcacgccgagatccagaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctgcaccgcctgcggcgtgtacctggacaagctgagaagcgtgggcaaggcctacaagatcgtgagcctgaagttcaccagaaaggtgtgcatccagctgggcaccgagcagacctgcaagcacatcgacgtgaacgactgcctggtgacccccagcgtgaaggtgtgcctgatcggcaccatcagcaagctgcagcccggcgacaccctgctgttcctgggccccctggagcagggcggcatcatcctgaagcagtggtgcaccaccagctgcgtgttcggcgaccccggcgacatcatgagcaccaccaccggcatgaagtgccccgagcacaccggcagcttcagaaagatctgcggcttcgccaccacccccacctgcgagtaccagggcaacaccatcagcggcttccagagaatgatggccaccagagacagcttccagagcttcaacgtgaccgagccccacatcaccagcaacagactggagtggatcgaccccgacagcagcatcaaggaccacatcaacatggtgctgaacagagacgtgagcttccaggacctgagcgacaacccctgcaaggtggacctgcacacccagagcatcgacggcgcctggggcagcggcgtgggcttcaccctggtgtgcaccgtgggcctgaccgagtgcgccaacttcatcaccagcatcaaggcctgcgacagcgccatgtgctacggcgccaccgtgaccaacctgctgagaggcagcaacaccgtgaaggtggtgggcaagggcggccacagcggcagcctgttcaagtgctgccacgacaccgactgcaccgaggagggcctggccgccagccccccccacctggacagagtgaccggctacaaccagatcgacagcgacaaggtgtacgacgacggcgcccccccctgcaccatcaagtgctggttcaccaagagcggcgagtggctgctgggcatcctgaacggcaactgggtggtggtggccgtgctgatcgtgatcctgatcctgagcatcctgctgttcagcttcttctgccccatcagaggcagaaagaacaagagcaactga

SEQ ID NO: 8498 - RNA, 3447 nt, synthetic construct
  misc_feature 1..3447: note = derived and/or modified CDS sequence (opt4) from PUUV(K27)__L08754.1__GP
  source 1..3447: mol_type = other RNA
atgggcgagctgagccccgtgtgcctgtacctgctgctgcagggcctgctgctgtgcaacaccggcgccgccagaaacctgaacgagctgaagatggagtgcccccacaccatcagactgggccagggcctggtggtgggcagcgtggagctgcccagcctgcccatccagcaggtggagaccctgaagctggagagcagctgcaacttcgacctgcacaccagcaccgccggccagcagagcttcaccaagtggacctgggagatcaagggcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcatcaccaccaagagctgcctgctgagcctgggcgaccagagaatccaggtgaactacgagaagacctactgcgtgagcggccagctggtggagggcatctgcttcaaccccatccacaccatggccctgagccagcccagccacacctacgacatcatgaccatgatggtgagatgcttcctggtgatcaagaaggtgaccagcggcgacagcatgaagatcgagaagaacttcgagaccctggtgcagaagaacggctgcaccgccaacaacttccagggctactacatctgcctgatcggcagcagcagcgagcccctgtacgtgcccgccctggacgactacagaagcgccgaggtgctgagcagaatggccttcgccccccacggcgaggaccacgacatcgagaagaacgccgtgagcgccatgagaatcgccggcaaggtgaccggcaaggcccccagcaccgagagcagcgacaccgtgcagggcatcgccttcagcggcagccccctgtacaccagcaccggcgtgctgaccagcaaggacgaccccgtgtacatctgggcccccggcatcatcatggagggcaaccacagcatctgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcagcatcaacagagtgcagagattcagaggcagcgagcagcagatcaagttcgtgtgccagagagtggacatggacatcaccgtgtactgcaacggcatgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccctgtgcttcggctgggtgctgatccccaccatcaccatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagctgagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctggccaccgccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctggtgagaggccagaacaccatccacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctggtggtgctgctgatcctgagcatcctgctgttcaccctgtgctgccccagaagacccagctacagaaaggagcacaagccctga

SEQ ID NO: 8499 - RNA, 3447 nt, synthetic construct
  misc_feature 1..3447: note = derived and/or modified CDS sequence (opt4) from PUUV(13891)__U22418.1__GP
  source 1..3447: mol_type = other RNA
atgggcaagatcatccccgtgtgcctgtacctgctgttcctgtgcctgctgctgtggaacagaggcgacgccagaaacctgaacgagctgaagatggagtgcccccacaccatcggcctgggccagggcctggtgatcggcagcgtggagctgccccccgtgcccctgacccaggtggagagcctgaagctggagagcagctgcaacttcgacctgcacaccagcaccagcagccagcagagcttcaccaagtggacctgggagatcaagaacgacctggccgagaacacccaggccagcagcaccagcttccagaccaagagcagcgagatcaacctgagaggcctgtgcctgatcccccccctggtgatcgagaccgccgccagaaccagaaagaccatcgcctgcttcgacctgagctgcaaccagaccgcctgccagcccaccgtgttcctgatcggccccatccagacctgcatcaccaccaagagctgcctgctgggcctgggcgaccagagaatccaggtgaactacgagaagacctactgcgtgagcggccagctggtggagggcgtgtgcttcaaccccgtgcacaccatggccctgagccagcccagccacacctacgacatcgtgaccgtgatggtgagatgcttcctgatcgtgaagaaggtgagcaccggcgacagcatgaagctggagaagagcttcgagaccctggtgcagaagaccggctgcaccggcaacggcttccagggctactacgtgtgcctggtgggcagcagcagcgagcccctgtacatccccaccctggacgactacagaagcgccgagatcctgagcagaatggccttcgccccccacggcgaggaccacgacgtggagaagaacgccatcagcgccatgagaatcgtgggcaaggtgaccggcaaggcccccagcaccgagagcagcgacaccatccagggcatcgccttcagcggcaaccccctgtacaccagcaccggcgtgctgaccgccaaggacgaccccgtgtacatctgggcccccggcatcatcatggagggcaaccacagcgtgtgcgacaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcatctgccagagagtggacatggacatcaccgtgtactgcaacggcctgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctggatcctgatccccttcttcagcatgatcctgctgaagatcctgatcgccttcgcctacctgtgcagcaagtacaacaccgacagcaagttcaagatcctgatcgagaaggtgaagagagagtaccagaagaccatgggcagcatggtgtgcgaggtgtgccagtacgagtgcgagaccgccaaggagctggagagccacagaaagagctgccccatcggcagctgcccctactgcctgaaccccgccgaggccaccaccagcgccctgcaggcccacttcaaggtgtgcaagctgaccagcagattccaggacaacctgagaaagagcctgggcgcctacgagcccaagcagggctgctacagaaccctgagcctgttcagatacagaagcagattcttcgtgggcttcaactggtgcctgctgctggtgctggagctgatcgtgtgggccgccagcgccgagacccagagcctgaacagcggctggaccgacaccgcccacggcagcggcatcatccccatgagaaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacggcaccttcaacctgaagaccgccttccactgctacggcagctgcgagaagtacgcctacccctggcagaccgccggctgcttcatcgagaaggactacgagtacgagagcggctggggctgcaacccccccgactgccccggcgtgggcaccggctgcaccgcctgcggcgtgtacctggacaagctgaagagcgtgggcaaggccttcaagatcgtgagcctgagatacaccagaaaggcctgcatccagctgggcaccgagcagacctgcaagagcgtggacagcaacgactgcctggtgaccaccagcgtgaaggtgtgcctgatcggcaccgtgagcaagttccagcccagcgacaccctgctgttcctgggccccctggagcagggcggcctgatcttcaagcagtggtgcaccaccacctgccagttcggcgaccccggcgacatcatgagcacccccgtgggcatgaagtgccccgagctgagcggcagcttcagaaagaagtgcgccttcgccaccacccccgtgtgccagttcgacggcaacaccctgagcggctacaagagaatgatcgccaccaaggacagcttccagagcttcaacgtgaccgagccccacatcagcgccagcagcctggagtggatcgaccccgacagcagcctgagagaccacatcaacgtgatcgtgggcagagacctgagcttccaggacctgagcgagaccccctgccaggtggacctggccaccaccagcatcgacggcgcctggggcagcggcgtgggcttcaacctggtgtgcagcgtgagcctgaccgagtgcagcaccttcctgaccagcatcaaggcctgcgacagcgccatgtgctacggcagcaccaccgccaacctgctgagaggccagaacaccgtgcacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatcagctgctggttcaccaagagcggcgagtggatcctgggcgtgctgaacggcaactggatggtggtggccgtgctgatcgccctgttcatcttcagcatcttcctgttcaccctgtgctgccccagaagacccagctacgccaaggagcacaagccctga

SEQ ID NO: 8500 - RNA, 3447 nt, synthetic construct
  misc_feature 1..3447: note = derived and/or modified CDS sequence (opt4) from PUUV(CG17/Baskiria-2001)__AF442614.1__GP
  source 1..3447: mol_type = other RNA
atgggcgagctgagccccgtgtgcctgtacctgctgctgcagggcctgctgctgtgcaacaccggcgccgccagaaacctgaacgagctgaagatggagtgcccccacaccatcggcctgggccagggcctggtggtgggcagcgtggagctgcccagcctgcccatccagcaggtggagaccctgaagctggagagcagctgcaacttcgacctgcacaccagcaccgccggccagcagagcttcaccaagtggacctgggagatcaagggcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcatcaccaccaagagctgcctgctgagcctgggcgaccagagaatccaggtgaactacgagaagacctactgcgtgagcggccagctggtggagggcatctgcttcaaccccatccacaccatggccctgagccagcccagccacacctacgacatcatgaccatgatggtgagatgcttcctggtgatcaagaaggtgaccagcggcgacagcatgaagatcgagaagaacttcgagaccctggtgcagaagaacggctgcaccgccaacaacttccagggctactacatctgcctgatcggcagcagcagcgagcccctgtacgtgcccgccctggacgactacagaagcgccgaggtgctgagcagaatggccttcgccccccacggcgaggaccacgacatcgagaagaacgccgtgagcgccatgagaatcgccggcaaggtgaccggcaaggcccccagcaccgagagcagcgacaccgtgcagggcatcgccttcagcggcagccccctgtacaccagcaccggcgtgctgaccagcaaggacgaccccgtgtacatctgggcccccggcatcatcatggagggcaaccacagcatctgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcatgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctgggtgctgatccccaccatcaccatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagctgagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctggccaccgccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctggtgagaggccagaacaccatccacatcgtgggcaagggcggccacagcggcagcaagttcatgtgctgccacgacaccaagtgcagcagcaccggcctggtggccgccgccccccacctggaccacgtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctggtggtgctgctgatcctgagcatcctgctgttcaccctgtgctgccccagaagacccagctacagaaaggagcacaagccctga

SEQ ID NO: 8501 - RNA, 3447 nt, synthetic construct
  misc_feature 1..3447: note = derived and/or modified CDS sequence (opt4) from PUUV(CG215/Omsk)__AF442615.1__GP
  source 1..3447: mol_type = other RNA
atgggcaagctgagccccgtgtgcctgtacctgctgctgcagtgcctgctgctgggcgacagaggcgacgccagaaacctgaacgagctgaagatggagtgcccccacaccatcggcctgggccagggcctggtggtgggcagcgtggagctgccccccgtgcccatccagcaggtggagagcctgaagctggagagcagctgcaacttcgacctgcacaccagcaccgccggccagcagagcttcaccaagtggacctgggagatcaagaacgacctggccgagaacacccaggccagcagcaccagcttccagaccaagagcagcgaggtgaacctgagaggcctgtgcctgatccccaccctggtggtggagaccgccgccagaaccagaaagaccatcgcctgctacgacctgacctgcaaccagaccgtgtgccagcccaccgtgtacctgatgggccccatccagacctgcgtgaccaccaagagctgcctgctgggcctgggcgaccagagaatccaggtgaactacgagaagacctactgcgtgagcggccagctggtggagggcgtgtgcttcaaccccatccacaccatggccctgagccagcccagccacacctacgacgtgatgaccctgatggtgagatgcttcctgatcatcaagaaggtgaccagcggcgacagcatgaagatcgagaagaacttcgagaccctggtgcagaagaccggctgcaccggcaacaacttccagggctactacatctgcctgatcggcagcagcagcgagcccctgtacgtgcccaccctggacgactacagaagcgccgaggtgctgagcagaatggccttcgccccccacggcgaggaccacgacatcgagaagaacgccgtgagcaccatgagaatcgccggcaaggtgaccggcagagcccccagcaccgaggccagcgacaccgtgcagggcatcgccttcagcggcagccccctgtacaccagcaccggcgtgctgaccgccaaggacgaccccgtgtacatctgggcccccggcatcatcatggagggcaaccacagcagctgcgacaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcatcgtgtactgcaacggcatcaagaaggtgatcctgaccaagaccctggtgatcggccagtgcatctacaccttcaccagcatcttcagcctgatccccggcgtggcccacagcctggccgtggagctgtgcgtgcccggcctgcacggctggaccaccatgctgctgctgctgaccttctgcttcggctgggtgctgatccccttcatcaccatgatcctgctgaagatcctgatcgccttcgcctacctgtgcagcaagtacaacaccgacagcaagttcagaatcctggtggagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcaagttcttcgtgggcctggtgtggtgcctgctgctggtgatggagctgatcgtgtgggccgccagcgccgagacccagaacctgaacagcggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgaagtacaccagaaaggtgtgcatccagctgggcaccgagcagacctgcaagaccgtggacagcaacgactgcctgatcaccaccagcgtgaaggtgtgcatgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcgccagcgccctggagtggatcgaccccgacagcagcctgagagaccacatcaacgtggtggtgggcagagacctgagcttccaggacctgagcgagaccccctgccaggtggacctgatgaccagcaccatcgacggcgcctggggcagcggcgtgggcttcaacctggtgtgcaccgtgagcctgaccgagtgcagccccttcctgaccagcatcaaggcctgcgacagcgccatgtgctacggcagcaccaccgtgaacctggtgagaggccagaacaccgtgcacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctgatcgccctgctgatcctgagcatcctgatgttcaccctgtgctgccccagaagacccagctacagaaaggagcacaagccctga

SEQ ID NO: 8502 - RNA, 3447 nt, synthetic construct
  misc_feature 1..3447: note = derived and/or modified CDS sequence (opt4) from PUUV(CG222/Omsk)__AF442616.1__GP
  source 1..3447: mol_type = other RNA
atgggcaagctgagccccgtgtgcctgtacctgctgctgcagtgcctgctgctgggcgacagaggcgacgccagaaacctgaacgagctgaagatggagtgcccccacaccatcggcctgggccagggcctggtggtgggcagcgtggagctgccccccgtgcccatccagcaggtggagagcctgaagctggagagcagctgcaacttcgacctgcacaccagcaccgccggccagcagagcttcaccaagtggacctgggagatcaagaacgacctggccgagaacacccaggccagcagcaccagcttccagaccaagagcagcgaggtgaacctgagaggcctgtgcctgatccccaccctggtggtggagaccgccgccagaaccagaaagaccatcgcctgctacgacctgacctgcaaccagaccgtgtgccagcccaccgtgtacctgatgggccccatccagacctgcgtgaccaccaagagctgcctgctgggcctgggcgaccagagaatccaggtgaactacgagaagacctactgcgtgagcggccagctggtggagggcgtgtgcttcaaccccatccacaccatggccctgagccagcccagccacacctacgacgtgatgaccctgatggtgagatgcttcctgatcatcaagaaggtgaccagcggcgacagcatgaagatcgagaagaacttcgagaccctggtgcagaagaccggctgcaccggcaacaacttccagggctactacatctgcctgatcggcagcagcagcgagcccctgtacgtgcccaccctggacgactacagaagcgccgaggtgctgagcagaatggccttcgccccccacggcgaggaccacgacatcgagaagaacgccgtgagcaccatgagaatcgccggcaaggtgaccggcagagcccccagcaccgaggccagcgacaccgtgcagggcatcgccttcagcggcagccccctgtacaccagcaccggcgtgctgaccgccaaggacgaccccgtgtacatctgggcccccggcatcatcatggagggcaaccacagcagctgcgacaagaagaccctgcccctgacctggaccggcttcatcagcctgcccggcgagatcgagaagaccacccagtgcaccgtgttctgcaccctggccggccccagagccgactgcgaggcctacagcgagaccggcatcttcaacatcagcagccccacctgcctgatcaacagagtgcagagattcagaggcgccgagcagcagatcaagttcgtgtgccagagagtggacatggacatcatcgtgtactgcaacggcatcaagaaggtgatcctgaccaagaccctggtgatcggccagtgcatctacaccttcaccagcatcttcagcctgatccccggcgtggcccacagcctggccgtggagctgtgcgtgcccggcctgcacggctggaccaccatgctgctgctgctgaccttctgcttcggctgggtgctgatccccttcatcaccatgatcctgctgaagatcctgatcgccttcgcctacctgtgcagcaagtacaacaccgacagcaagttcagaatcctggtggagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcaagttcttcgtgggcctggtgtggtgcctgctgctggtgatggagctgatcgtgtgggccgccagcgccgagacccagaacctgaacagcggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgaagtacaccagaaaggtgtgcatccagctgggcaccgagcagacctgcaagaccgtggacagcaacgactgcctgatcaccaccagcgtgaaggtgtgcatgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcgccagcgccctggagtggatcgaccccgacagcagcctgagagaccacatcaacgtggtggtgggcagagacctgagcttccaggacctgagcgagaccccctgccaggtggacctgatgaccagcaccatcgacggcgcctggggcagcggcgtgggcttcaacctggtgtgcaccgtgagcctgaccgagtgcagcgccttcctgaccagcatcaaggcctgcgacagcgccatgtgctacggcagcaccaccgtgaacctggtgagaggccagaacaccgtgcacatcgtgggcaagggcggccacagcggcagcaagttcatgtgctgccacgacaccaagtgcagcagcaccggcctggtggccgccgccccccccctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctgatcgccctgctgatcctgagcatcctgatgttcaccctgtgctgccccagaagacccagctacagaaaggagcacaagccctga

SEQ ID NO: 8503 - RNA, 3447 nt, synthetic construct
  misc_feature 1..3447: note = derived and/or modified CDS sequence (opt4) from PUUV(CRF161)__AF367061.1__GP
  source 1..3447: mol_type = other RNA
atgggcaagctgagccccgtgtgcctgtacctgctgctgcagtgcctgctgctgggcgacagaggcgacgccagaaacctgaacgagctgaagatggagtgcccccacaccatcggcctgggccagggcctggtggtgggcagcgtggagctgccccccgtgcccatccagcaggtggagagcctgaagctggagagcagctgcaacttcgacctgcacaccagcaccgccggccagcagagcttcaccaagtggacctgggagatcaagaacgacctggtggagaacacccaggccagcagcaccagcttccagaccaagagcagcgaggtgaacctgagaggcctgtgcctgatccccaccctggtggtggagaccgccgccagaaccagaaagaccatcgcctgctacgacctgacctgcaaccagaccgtgtgccagcccaccgtgtacctgatgggccccatccagacctgcatcaccaccaagagctgcctgctgggcctgggcgaccagagaatccaggtgaactacgagaagacctactgcgtgagcggccagctggtggagggcgtgtgcttcaaccccatccacaccatggccctgagccagcccagccacacctacgacgtgatgaccctgatggtgagatgcttcctgatcatcaagaaggtgaccagcggcgacagcatgaagatcgagaagaacttcgagaccctggtgcagaagaccggctgcaccggcaacaacttccagggctactacatctgcctgatcggcagcagcagcgagcccctgtacgtgcccaccctggacgactacagaagcgccgaggtgctgagcagaatggccttcgccccccacggcgaggaccacgacatcgagaagaacgccgtgagcaccatgagaatcgccggcaaggtggccggcagagcccccagcaccgaggccagcgacaccgtgcagggcatcgccttcagcggcagccccctgtacaccagcaccggcgtgctgaccgccaaggacgaccccgtgtacatctgggcccccggcatcatcatggagggcaaccacagcagctgcgacaagaagaccctgcccctgacctggaccggcttcatcagcctgcccggcgagatccagaagaccacccagtgcaccgtgttctgcaccctggccggccccagagccgactgccaggcctacagcgagaccggcatcttcaacatcagcagccccacctgcctgatcaacagagtgcagagattcagaggcgccgagcagcagatcaagttcgtgtgccagagagtggacatggacatcatcgtgtactgcaacggcatcaagaaggtgatcctgaccaagaccctggtgatcggccagtgcatctacaccttcaccagcatcttcagcctgatccccggcgtggcccacagcctggccgtggagctgtgcgtgcccggcctgcacggctggaccaccatgctgctgctgctgaccttctgcttcggctgggtgctgatccccttcatcaccatgatcctgctgaagatcctgatcgccttcgcctacctgtgcagcaagtacaacaccgacagcaagttcagaatcctggtggagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcaagttcttcgtgggcctggtgtggtgcctgctgctggtgatggagctgatcgtgtgggccgccagcgccgagacccagaacctgaacagcggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgaagtacaccagaaaggtgtgcatccagctgggcaccgagcagacctgcaagaccgtggacagcaacgactgcctgatcaccaccagcgtgaaggtgtgcatgatcggcaccatcagcaagttccagcccagcgacaccctgctgatcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcgccagcgccctggagtggatcgaccccgacagcagcctgagagaccacatcaacgtggtggtgggcagagacctgagcttccaggacctgagcgagaccccctgccaggtggacctgatgaccagcaccatcgacggcgcctggggcagcggcgtgggcttcaacctggtgtgcaccgtgagcctgaccgagtgcagcgccttcctgaccagcatcaaggcctgcgacagcgccatgtgctacggcagcaccaccgccaacctggtgaagggccagaacaccgtgcacatggtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctgatcgccctgctgatcctgagcatcctgatgttcaccctgtgctgccccagaagacccagctacagaaaggagcacaagccctga

SEQ ID NO: 8504 - RNA, 3447 nt, synthetic construct
  misc_feature 1..3447: note = derived and/or modified CDS sequence (opt4) from PUUV(CRF308/Omsk)__AF442617.1__GP
  source 1..3447: mol_type = other RNA
atgggcaagctgagccccgtgtgcctgtacctgctgctgcagtgcctgctgctgggcgacagaggcgacgccagaaacctgaacgagctgaagatggagtgcccccacaccatcggcctgggccagggcctggtggtgggcagcgtggagctgccccccgtgcccatccagcaggtggagagcctgaagctggagagcagctgcaacttcgacctgcacaccagcaccgccggccagcagagcttcaccaagtggacctgggagatcaagaacgacctggccgagaacacccaggccagcagcaccagcttccagaccaagagcagcgaggtgaacctgagaggcctgtgcctgatccccaccctggtggtggagaccgccgccagaaccagaaagaccatcgcctgctacgacctgacctgcaaccagaccgtgtgccagcccaccgtgtacctgatgggccccatccagacctgcatcaccaccaagagctgcctgctgggcctgggcgaccagagaatccaggtgaactacgagaagacctactgcgtgagcggccagctggtggagggcgtgtgcttcaaccccatccacaccatggccctgagccagcccagccacacctacgacgtgatgaccctgatggtgagatgcttcctgatcatcaagaaggtgaccagcggcgacagcatgaagatcgagaagaacttcgagaccctggtgcagaagaccggctgcaccggcaacaacttccagggctactacatctgcctgatcggcagcagcagcgagcccctgtacgtgcccaccctggacgactacagaagcgccgaggtgctgagcagaatggccttcgccccccacggcgaggaccacgacatcgagaagaacgccgtgagcaccatgagaatcgccggcaaggtggccggcagagcccccagcaccgaggccagcgacaccgtgcagggcatcgccttcagcggcagccccctgtacaccagcaccggcgtgctgaccgccaaggacgaccccgtgtacatctgggcccccggcatcatcatggagggcaaccacagcagctgcgacaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcatcgtgtactgcaacggcatcaagaaggtgatcctgaccaagaccctggtgatcggccagtgcatctacaccttcaccagcatcttcagcctgatccccggcatcgcccacagcctggccgtggagctgtgcgtgcccggcctgcacggctggaccaccatgctgctgctgctgaccttctgcttcggctgggtgctgatccccttcatcaccatgatcctgctgaagatcctgatcgccttcgcctacctgtgcagcaagtacaacaccgacagcaagttcagaatcctggtggagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcaagttcttcgtgggcctggtgtggtgcctgctgctggtgatggagctgatcgtgtgggccgccagcgccgagacccagaacctgaacagcggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgaagtacaccagaaaggtgtgcatccagctgggcaccgagcagacctgcaagaccgtggacagcaacgactgcctgatcaccaccagcgtgaaggtgtgcatgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcgccagcgccctggagtggatcgaccccgacagcagcctgagagaccacatcaacgtggtggtgggcagagacctgagcttccaggacctgagcgagaccccctgccaggtggacctgatgaccagcaccatcgacggcgcctggggcagcggcgtgggcttcaacctggtgtgcaccgtgagcctgaccgagtgcagcgccttcctgaccagcatcaaggcctgcgacagcgccatgtgctacggcagcaccaccgccaacctggtgagaggccagaacaccgtgcacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctgatcgccctgctgatcctgagcatcctgatgttcaccctgtgctgccccagaagacccagctacagaaaggagcacaagccctga

SEQ ID NO: 8505 - RNA, 3447 nt, synthetic construct
  misc_feature 1..3447: note = derived and/or modified CDS sequence (opt4) from PUUV(Mu/07/1219)__KJ994777.1__GP
  source 1..3447: mol_type = other RNA
atggagaagatcatccccgtgtgcctgtacctgcccttcctgtgcctgctgctgtggagcagaggcgacaccagaaacctgaacgagctgaagatggagtgcccccacaccatcggcctgggccagggcctggtgatcggcagcatcgagctgccccccgtgcccctgatccaggtggagagcctgaagctggagagcagctgcaacttcgacctgcacaccagcaccagcagccagcaggccttcaccaagtggacctgggaggtgaagagcgacctggccgagaacacccaggccagcagcaccagcttccagaccaagagcagcgaggtgaacctgagaggcctgtgcctggtgccccccctggtgatcgagaccgccgccagaaccagaaagaccatcgcctgcttcgacctgagctgcaaccagaccacctgccagcccaccgtgttcctgatgggccccatccagacctgcatcaccaccaagagctgcctgctgggcctgggcgaccagagaatccaggtgaactacgagaagacctactgcgtgagcggccagctgatcgagggcatctgcttcaaccccgtgcacaccatggccctgagccagcccagccacacctacgacatcgtgaccgtgatggtgagatgcttcctgatcgtgaagaaggtgaccaccggcgacagcatgaagatcgagaagagcttcgagaccctggtgcagaagaccggctgcaccgacaacggcttccagggctactacgtgtgcctgatcggcagcagcagcgagcccctgtacatccccaccctggacgactacagaagcgccgaggtgctgagcagaatggccttcgccccccacggcgaggaccacgacatcgagaagaacgccatcagcgccatgagaatcgtgggcaaggtgaccggcaaggcccccagcaccgagagcagcgacaccgtgcagggcatcgccttcagcggcaaccccctgtacaccagcaccggcgtgctgaccgccaaggacgaccccgtgtacgtgtgggcccccggcatcatgatggagggcaaccacagcgtgtgcgagaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcatctgccagagagtggacatggacatcaccgtgtactgcaacggcctgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctggatcctgatccccttcttcgccatgatcctgctgaaggtgctgatcgccctggcctacctgtgcagcaagtacaacaccgacagcaagttcaaggtgctgatcgagaaggtgaagaaggagtaccagaagaccatgggcagcatggtgtgcgaggtgtgccagtacgagtgcgagaccgccaaggagctggagagccacagaaagagctgccccatgggcagctgcccctactgcctgaaccccgccgaggccaccaccagcgccctgcaggcccacttcaaggtgtgcaagctgaccagcagattccaggacaacctgagaaagagcctgggcgcctacgagcccaagcagggctgctacagaaccctgagcctgttcagatacagaagcagattcttcgtgggcttcatctggtgcctgctgctggtgctggagctgatcgtgtgggccgccagcgccgagacccagaacctgaacagcggctggaccgacaccgcccacggcagcggcgtgatccccatgagaaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacggcaccttcaacctgaagaccgccttccactgctacggcagctgcgagaagtacgcctacccctggcagaccgccggctgcttcgtggagaaggactacgagtacgagagcggctggggctgcaaccccgccgactgccccggcgtgggcaccggctgcaccgcctgcggcgtgtacctggacaagctgaagagcgtgggcaaggccttcaagatcgtgagcctgagatacaccagaaaggcctgcatccagctgggcaccgagcagacctgcaagaacgtggacagcaacgactgcctggtgaccaccagcgtgaaggtgtgcctgatcggcaccgtgagcaagttccagcccagcgacaccctgctgttcctgggccccctggagcagggcggcctgatcttcaagcagtggtgcaccaccacctgccagttcggcgaccccggcgacatcatgagcacccccgtgggcatgaagtgccccgagctgagcggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcgccagcagcctggagtggatcgaccccgacagcagcctgagagaccacatcaacgtgatcgtgggcagagacctgagcttccaggacctgagcgagaccccctgccaggtggacctgaccaccaccagcatcgacggcgcctggggcagcggcgtgggcttcaacctgatctgcagcgtgagcctgaccgagtgcagcaccttcctgaccagcatcaaggcctgcgacagcgccatgtgctacggcagcaccaccgccaacctggtgagaggccagaacaccgtgcacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatcagctgctggttcaccaagagcggcgagtggatcctgggcgtgctgaacggcaactggatggtggtggccgtgctggtggccctgttcatcctgagcatcttcctgttcaccctgtgctgccccagaagacccagctacgccaaggagcacaagccctga

SEQ ID NO: 8506 - RNA, 3447 nt, synthetic construct
  misc_feature 1..3447: note = derived and/or modified CDS sequence (opt4) from PUUV(Puu/Kazan)__Z84205.1__GP
  source 1..3447: mol_type = other RNA
atgggcaagctgagccccgtgtgcctgtacctgctgctgcagggcctgctgctgttcaacaccggcaccgccagaaacctgaacgagctgaagatggagtgcccccacaccatcggcctgggccagggcctggtggtgggcagcgtggagctgccccccgtgcccatccagcaggtggagaccctgaagctggagagcagctgcaacttcgacctgcacaccagcaccgccggccagcaggccttcaccaagtggacctgggagatcaagggcgacctggccgagaacacccaggccagcagcaccagcttccagaccaagagcagcgaggtgaacctgagaggcctgtgcctgatccccaccctggtgatcgagaccgccgccagaatgagaaagaccatcgcctgctacgacctgagctgcaaccagaccgtgtgccagcccaccgtgtacctgatgggccccatccagacctgcatcaccaccaagagctgcctgctgggcctgggcgaccagagaatccaggtgaactacgagaagacctactgcgtgagcggccagctggtggagggcgtgtgcttcaaccccatccacaccatggccctgagccagcccagccacacctacgacatcgtgaccatgatggtgagatgcttcctggtgatcaagaaggtgaccagcggcgacagcatgaagatcgagaagaacttcgagaccctggtgcagaagaacggctgcaccgccaacagcttccagggctactacatctgcctgatcggcagcagcagcgagcccctgtacgtgcccaccctggacgactacagaagcgccgaggtgctgagcagaatggccttcgccccccacggcgaggaccacgacgtggagaagaacgccatcagcgccctgagaatcgccggcaaggtgaccggcaaggcccccagcaccgagagcagcgacaccgtgcagggcgtggccttcagcggcagccccctgtacaccagcaccggcgtgctgaccgccaaggacgaccccgtgtacatctgggcccccggcatcatcatggagggcaaccacagcgtgtgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcgtgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctgggtgctgatccccaccatcaccatgatcctgctgaagatcctgatcgccttcgcctacctgtgcagcaagtacaacaccgacagcaagttcagaatcctgatcgagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagaatccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaacatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcgtggagaaggactacgagtacgagaccggctggggctgcaacccccccgactgccccggcgtgggcaccggctgcaccgcctgcggcgcctacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgacctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcgccagcgccctggagtggatcgaccccgacagcagcctgagagaccacatcaacgtgatcgtgagcagagacctgagcttccaggacctgagcgagaccccctgccagatcgacctgagcaccgccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctggtgagaggccagaacaccatccacatcgtgggcaagggcggccacagcggcagcaagttcatgtgctgccacgacaccaagtgcagcaccaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctgatcgccctgctgatcctgagcatcctgctgttcaccctgtgctgccccagaagacccagctacagaaaggagcacaagccctga

SEQ ID NO: 8507 - RNA, 3447 nt, synthetic construct
  misc_feature 1..3447: note = derived and/or modified CDS sequence (opt4) from PUUV(PUUV/Ardennes/Mg156/2011)__KT247603.1__GP
  source 1..3447: mol_type = other RNA
atgggcaagatcatccccgtgtgcctgtacctgctgttcctgtgcctgctgctgtgggacagaggcgacaccagaaacctgaacgagctgaagatggagtgcccccacaccatcggcctgggccagggcctggtgatcggcagcgtggagctgccccccgtgcccctgacccaggtggagagcctgaagctggagagcagctgcaacttcgacctgcacaccagcaccagcagccagcagagcttcaccaagtggacctgggagatgaaggtggacctggccgagaacacccaggccagcagcaccagcttccagaccaagagcagcgagatcaacctgagaggcctgtgcctggtgccccccctggtgatcgagaccgccgccagaaccagaaagaccatcgcctgcttcgacctgagctgcaaccagaccgcctgccagcccaccgtgttcctgatcggccccatccagacctgcatcaccaccaagagctgcctgctgggcctgggcgaccagagaatccaggtgaactacgagaagacctactgcgtgagcggccagctggtggagggcatctgcttcaaccccgtgcacaccatggccctgagccagcccagccacacctacgacatcgtgaccgtgatggtgagatgcttcctgatcgtgaagaaggtgagcaccggcgacagcatgaagctggagaagagcttcgagaccctggtgcagaagaccggctgcaccggcaacggcttccagggctactacgtgtgcctgatcggcagcagcagcgagcccctgtacatccccaccctggacgactacagaagcgccgaggtgctgagcagaatggccttcgccccccacggcgaggaccacgacatcgagaagaacgccatcagcgccatgagaatcgtgggcaaggtgaccggcaaggcccccagcaccgagagcagcgacaccgtgcagggcatcgccttcagcggcaaccccctgtacaccagcaccggcgtgctgaccgccaaggacgaccccatctacatctgggcccccggcatcatcatggagggcaaccacagcgtgtgcgacaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcatctgccagagagtggacatggacatcaccgtgtactgcaacggcctgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctggatcctgatccccttcttcagcatgatcctgctgaagatcctgatcgccttcgcctacctgtgcagcaagtacaacaccgacagcaagttcaagatcctgatcgagaaggtgaagaaggagtaccagaagaccatgggcagcatggtgtgcgaggtgtgccagtacgagtgcgagaccgccaaggagctggagagccacagaaagagctgccccatgggcagctgcccctactgcctgaaccccgccgaggccaccaccagcgccctgcaggcccacttcaaggtgtgcaagctgaccagcagattccaggacaacctgagaaagagcctgggcgcctacgagcccaagcagggctgctacagaaccctgagcctgttcagatacagaagcagattcttcgtgggcttcatctggtgcttcctgctggtgctggagctgatcgtgtgggccgccagcgccgagacccagaacctgaacagcggctggaccgacaccgcccacggcagcggcatcatccccatgagaaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacggcaccttcaacctgaagaccgccttccactgctacggcagctgcgagaagtacgcctacccctggcagaccgccggctgcttcgtggagaaggactacgagtacgagagcggctggggctgcaacccccccgactgccccggcgtgggcaccggctgcaccgcctgcggcgtgtacctggacaagctgaagagcgtgggcaaggccttcaagatcgtgagcctgagatacaccagaaaggcctgcatccagctgggcaccgagcagacctgcaagagcgtggacagcaacgactgcctggtgaccaccagcgtgaaggtgtgcctgatcggcaccgtgagcaagttccagcccagcgacaccctgctgttcctgggccccctggagcagggcggcctgatcttcaagcagtggtgcaccaccacctgccagttcggcgaccccggcgacatcatgagcacccccgtgggcatgaagtgccccgagctgagcggcagcttcagaaagaagtgcgccttcgccaccacccccgtgtgccagttcgacggcaacaccctgagcggctacaagagaatgatcgccaccaaggacagcttccagagcttcaacgtgaccgagccccacatcagcgccagcagcctggagtggatcgaccccgacagcagcctgagagaccacatcaacgtgatcgtgggcagagacctgagcttccaggacctgagcgagaccccctgccaggtggacctggccaccagcagcatcgacggcgcctggggcagcggcgtgggcttcaacctggtgtgcagcgtgagcctgaccgagtgcagcaccttcctgaccagcatcaaggcctgcgacagcgccatgtgctacggcagcaccaccgccaacctgctgagaggccagaacaccgtgcacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatcagctgctggttcaccaagagcggcgagtggatcctgggcgtgctgaacggcaactggatggtggtggccgtgctggtggccctgttcatcctgagcatcttcctgttcaccctgtgctgccccagaagacccagctacgccaaggagcacaagccctga

SEQ ID NO: 8508 - RNA, 3447 nt, synthetic construct
  misc_feature 1..3447: note = derived and/or modified CDS sequence (opt4) from PUUV(PUUV/Ardennes/Mg75/2011)__KT247602.1__GP
  source 1..3447: mol_type = other RNA
atgggcaagatcatccccgtgtgcctgtacctgctgttcctgtgcctgctgctgtgggacagaggcgacaccagaaacctgaacgagctgaagatggagtgcccccacaccatcggcctgggccagggcctggtgatcggcagcgtggagctgccccccgtgcccctgacccaggtggagagcctgaagctggagagcagctgcaacttcgacctgcacaccagcaccagcagccagcagagcttcaccaagtggacctgggagatgaaggtggacctggccgagaacacccaggccagcagcaccagcttccagaccaagagcagcgagatcaacctgagaggcctgtgcctggtgccccccctggtgatcgagaccgccgccagaaccagaaagaccatcgcctgcttcgacctgagctgcaaccagaccgcctgccagcccaccgtgttcctgatcggccccatccagacctgcatcaccaccaagagctgcctgctgggcctgggcgaccagagaatccaggtgaactacgagaagacctactgcgtgagcggccagctggtggagggcatctgcttcaaccccgtgcacaccatggccctgagccagcccagccacacctacgacatcgtgaccgtgatggtgagatgcttcctgatcgtgaagaaggtgagcaccggcgacagcatgaagctggagaagagcttcgagaccctggtgcagaagaccggctgcaccggcaacggcttccagggctactacgtgtgcctgatcggcagcagcagcgagcccctgtacatccccaccctggacgactacagaagcgccgaggtgctgagcagaatggccttcgccccccacggcgaggaccacgacatcgagaagaacgccatcagcgccatgagaatcgtgggcaaggtgaccggcaaggcccccagcaccgagagcagcgacaccgtgcagggcatcgccttcagcggcaaccccctgtacaccagcaccggcgtgctgaccgccaaggacgaccccatctacatctgggcccccggcatcatcatggagggcaaccacagcgtgtgcgacaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcatctgccagagagtggacatggacatcaccgtgtactgcaacggcctgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctggatcctgatccccttcttcagcatgatcctgctgaagatcctgatcgccttcgcctacctgtgcagcaagtacaacaccgacagcaagttcaagatcctgatcgagaaggtgaagaaggagtaccagaagaccatgggcagcatggtgtgcgaggtgtgccagtacgagtgcgagaccgccaaggagctggagagccacagaaagagctgccccatgggcagctgcccctactgcctgaaccccgccgaggccaccaccagcgccctgcaggcccacttcaaggtgtgcaagctgaccagcagattccaggacaacctgagaaagagcctgggcgcctacgagcccaagcagggctgctacagaaccctgagcctgttcagatacagaagcagattcttcgtgggcttcatctggtgcttcctgctggtgctggagctgatcgtgtgggccgccagcgccgagacccagaacctgaacagcggctggaccgacaccgcccacggcagcggcatcatccccatgagaaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacggcaccttcaacctgaagaccgccttccactgctacggcagctgcgagaagtacgcctacccctggcagaccgccggctgcttcgtggagaaggactacgagtacgagagcggctggggctgcaacccccccgactgccccggcgtgggcaccggctgcaccgcctgcggcgtgtacctggacaagctgaagagcgtgggcaaggccttcaagatcgtgagcctgagatacaccagaaaggcctgcatccagctgggcaccgagcagacctgcaagagcgtggacagcaacgactgcctggtgaccaccagcgtgaaggtgtgcctgatcggcaccgtgagcaagttccagcccagcgacaccctgctgttcctgggccccctggagcagggcggcctgatcttcaagcagtggtgcaccaccacctgccacttcggcgaccccggcgacatcatgagcacccccgtgagcatgaagtgccccgagctgagcggcagcttcagaaagaagtgcgccttcgccaccacccccgtgtgccagttcgacggcaacaccctgagcggctacaagagaatgatcgccaccaaggacagcttccagagcttcaacgtgaccgagccccacatcagcgccagcagcctggagtggatcgaccccgacagcagcctgagagaccacatcaacgtgatcgtgggcagagacctgagcttccaggacctgagcgagaccccctgccaggtggacctggccaccagcagcatcgacggcgcctggggcagcggcgtgggcttcaacctggtgtgcagcgtgagcctgaccgagtgcagcaccttcctgaccagcatcaaggcctgcgacagcgccatgtgctacggcagcaccaccgccaacctgctgagaggccagaacaccgtgcacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatcagctgctggttcaccaagagcggcgagtggatcctgggcgtgctgaacggcaactggatggtggtggccgtgctggtggccctgttcatcctgagcatcttcctgttcaccctgtgctgccccagaagacccagctacgccaaggagcacaagccctga

SEQ ID NO: 8509 - RNA, 3447 nt, synthetic construct
  misc_feature 1..3447: note = derived and/or modified CDS sequence (opt4) from PUUV(PUUV/Jura/Mg2/2010)__KT247598.1__GP
  source 1..3447: mol_type = other RNA
atgggcaagatcatccccgtgtgcctgtacctgctgttcctgtgcctgctgctgtggaacagaggcgacaccagaaacctgaacgagctgaagatggagtgcccccacaccatcggcctgggccagggcctggtgatcggcagcgtggagctgccccccgtgcccctgacccaggtggagagcctgaagctggagagcagctgcaacttcgacctgcacaccagcaccagcagccagcagagcttcaccaagtggacctgggagatgaagagcgacctggccgagaacacccaggccagcagcaccagcttccagaccaagagcagcgagatcaacctgagaggcctgtgcctggtgccccccctggtgatcgagaccgccgccagaaccagaaagaccatcgcctgcttcgacctgagctgcaaccagaccgcctgccagcccaccgtgttcctgatcggccccatccagacctgcctgaccaccaagagctgcctgctgggcctgggcgaccagagaatccaggtgaactacgagaagacctactgcgtgagcggccagctggtggagggcgtgtgcttcaaccccatccacaccatggccctgagccagcccagccacacctacgacatcgtgaccgtgatggtgagatgcttcctgatcgtgaagaaggtgagcaccggcgacagcatgaagatcgagaagagcttcgagaccctggtgcagaagaccggctgcaccggcaacggcttccagggctactacgtgtgcctgatcggcagcagcagcgagcccctgtacatccccaccctggacgactacagaagcgccgaggtgctgagcagaatggccttcgccccccacggcgaggaccacgacatcgagaagaacgccatcagcgccatgagaatcgtgggcaaggtgaccggcaaggcccccagcaccgagagcagcgacaccgtgcagggcatcgccttcagcggcaaccccctgtacaccagcaccggcgtgctgaccgccaaggacgaccccatctacatctgggcccccggcatcatcatggagggcaaccacagcgtgtgcgagaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcatctgccagagagtggacatggacatcaccgtgtactgcaacggcctgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctggatcctgatccccttcaccgccatgctgctgctgaagatcctgatcgccttcgcctacctgtgcagcaagtacaacaccgacagcaagttcaagatcctgatcgagaaggtgaagaaggagtaccagaagaccatgggcagcatggtgtgcgaggtgtgccagtacgagtgcgagaccgccaaggagctggagagccacagaaagagctgccccatgggcagctgcccctactgcctgaaccccgccgaggccaccaccagcgccctgcaggcccacttcaaggtgtgcaagctgaccagcagattccaggacaacctgagaaagagcctgggcgcctacgagcccaagcagggctgctacagaaccctgagcctgttcagatacagaagcagattcttcgtgggcctggtgtggtgcttcctgctggtgctggagctgatcatctgggccgccagcgccgagacccagaacctgaacagcggctggaccgacaccgcccacggcagcggcgtgatccccatgagaaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacggcaccttcaacctgaagaccgccttccactgctacggcagctgcgagaagtacgcctacccctggcagaccgccggctgcttcgtggagaaggactacgagtacgagagcggctggggctgcaacccccccgactgccccggcgtgggcaccggctgcaccgcctgcggcgtgtacctggacaagctgaagagcgtgggcaaggccttcagaatcgtgagcctgaagtacaccagaaaggcctgcatccagctgggcaccgagcagacctgcaagagcgtggacagcaacgactgcctggtgaccaccagcgtgaaggtgtgcctgatcggcaccgtgagcaagttccagcccagcgacaccctgctgttcctgggccccctggagcagggcggcctgatcttcaagcagtggtgcaccaccacctgccagttcggcgaccccagagacatcatgagcacccccgtgggcatgagatgccccgagctgagcggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcgccagcagcctggagtggatcgaccccgacagcagcctgagagaccacatcaacgtgatcgtgggcagagacctgagcttccaggacctgagcgagaccccctgccaggtggacctgaccaccaccagcatcgacggcgcctggggcagcggcgtgggcttcaacctgatctgcagcgtgagcctgaccgagtgcagcaccttcctgaccagcatcaaggcctgcgacagcgccatgtgctacggcagcaccaccgccaacctgatgagaggccagaacaccatccacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatcagctgctggttcaccaagagcggcgagtggatcctgggcgtgctgaacggcaactggatggtggtggccgtgctggtggtgctgttcatcctgagcatcttcctgttcaccctgtgctgccccagaagacccagctacgccaaggagcacaagccctga

SEQ ID NO: 8510 - RNA, 3447 nt, synthetic construct
  misc_feature 1..3447: note = derived and/or modified CDS sequence (opt4) from PUUV(PUUV/Jura/Mg214/2010)__KT247599.1__GP
  source 1..3447: mol_type = other RNA
atgggcaagatcatccccgtgtgcctgtacctgctgttcctgtgcctgctgctgtggaacagaggcgacaccagaaacctgaacgagctgaagatggagtgcccccacaccatcggcctgggccagggcctggtgatcggcagcgtggagctgccccccgtgcccctgacccaggtggagagcctgaagctggagagcagctgcaacttcgacctgcacaccagcaccagcagccagcagagcttcaccaagtggacctgggagatgaagagcgacctggccgagaacacccaggccagcagcaccagcttccagaccaagagcagcgagatcaacctgagaggcctgtgcctggtgccccccctggtgatcgagaccgccgccagaaccagaaagaccatcgcctgcttcgacctgagctgcaaccagaccgcctgccagcccaccgtgttcctgatcggccccatccagacctgcctgaccaccaagagctgcctgctgggcctgggcgaccagagaatccaggtgaactacgagaagacctactgcgtgagcggccagctggtggagggcgtgtgcttcaaccccatccacaccatggccctgagccagcccagccacacctacgacatcgtgaccgtgatggtgagatgcttcctgatcgtgaagaaggtgagcaccggcgacagcatgaagatcgagaagagcttcgagaccctggtgcagaagaccggctgcaccggcaacggcttccagggctactacgtgtgcctgatcggcagcagcagcgagcccctgtacatccccaccctggacgactacagaagcgccgaggtgctgagcagaatggccctggccccccacggcgaggaccacgacatcgagaagaacgccatcagcgccatgagaatcgtgggcaaggtgaccggcaaggcccccagcaccgagagcagcgacaccgtgcagggcatcgccttcagcggcaaccccctgtacaccagcaccggcgtgctgaccgccaaggacgaccccatctacatctgggcccccggcatcatcatggagggcaaccacagcgtgtgcgagaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcatctgccagagagtggacatggacatcaccgtgtactgcaacggcctgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctggatcctgatccccttcaccgccatgctgctgctgaagatcctgatcgccttcgcctacctgtgcagcaagtacaacaccgacagcaagttcaagatcctgatcgagaaggtgaagaaggagtaccacaagagcatgggcagcatggtgtgcgaggtgtgccagtacgagtgcgagaccgccaaggagctggagagccacagaaagagctgccccatgggcagctgcccctactgcctgaaccccgccgaggccaccaccagcgccctgcaggcccacttcaaggtgtgcaagctgaccagcagattccaggacaacctgagaaagagcctgggcgcctacgagcccaagcagggctgctacagaaccctgagcctgttcagatacagaagcagattcttcgtgggcctggtgtggtgcttcctgctggtgctggagctgatcatctgggccgccagcgccgagacccagaacctgaacagcggctggaccgacaccgcccacggcagcggcgtgatccccatgagaaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacggcaccttcaacctgaagaccgccttccactgctacggcagctgcgagaagtacgcctacccctggcagaccgccggctgcttcgtggagaaggactacgagtacgagagcggctggggctgcaacccccccgactgccccggcgtgggcaccggctgcaccgcctgcggcgtgtacctggacaagctgaagagcgtgggcaaggccttcagaatcgtgagcctgaagtacaccagaaaggcctgcatccagctgggcaccgagcagacctgcaagagcgtggacagcaacgactgcctggtgaccaccagcgtgaaggtgtgcctgatcggcaccgtgagcaagttccagcccagcgacaccctgctgttcctgggccccctggagcagggcggcctgatcttcaagcagtggtgcaccaccacctgccagttcggcgaccccggcgacatcatgagcacccccgtgggcatgagatgccccgagctgagcggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcgccagcagcctggagtggatcgaccccgacagcagcctgagagaccacatcaacgtgatcgtgggcagagacctgagcttccaggacctgagcgagaccccctgccaggtggacctgaccaccaccagcatcgacggcgcctggggcagcggcgtgggcttcaacctgatctgcagcgtgagcctgaccgagtgcagcaccttcctgaccagcatcaaggcctgcgacagcgccatgtgctacggcagcaccaccgccaacctgatgagaggccagaacaccatccacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatcagctgctggttcaccaagagcggcgagtggatcctgggcgtgctgaacggcaactggatggtggtggccgtgctggtggtgctgttcatcctgagcatcttcctgttcaccctgtgctgccccagaagacccagctacgccaaggagcacaagccctga

SEQ ID NO: 8511 - RNA, 3447 nt, synthetic construct
  misc_feature 1..3447: note = derived and/or modified CDS sequence (opt4) from PUUV(PUUV/Orleans/Mg23/2010)__KT247600.1__GP
  source 1..3447: mol_type = other RNA
atgggcaagatcatccccgtgtgcctgtacctgctgttcagatgcctgctgctgtgggacagaggcaacgccagaaacctgaacgagctgaagatggagtgcccccacaccatcggcctgggccagggcctggtgatcggcagcgtggagctgccccccgtgcccctgacccagatcgagagcctgaagctggagagcagctgcaacttcgacctgcacaccagcaccagcagccagcagagcttcaccaagtggacctgggagatcaagagcgacctggccgagaacacccaggccagcagcaccagcttccagaccaagagcagcgaggtgaacctgagaggcctgtgcctggtgccccccctggtgatcgagaccgccgccagaaccagaaagaccatcgcctgcttcgacctgagctgcaaccagaccgcctgccagcccaccgtgttcctgatcggccccatccagacctgcatcaccaccaagagctgcctgctgggcctgggcgaccagagaatccaggtgaactacgagaagacctactgcgtgagcggccagctgatcgagggcatctgcttcaaccccgtgcacaccatggccctgagccagcccagccacacctacgacgtggtgaccgtgatggtgagatgcttcctgatcgtgaagaaggtgagcaccggcgacagcatgaagatcgagaagagcttcgagaccctggtgcagaagaccggctgcaccggcaacggcttccagggctactacgtgtgcctgatcggcagcagcagcgagcccctgtacatccccaccctggacgactacagaagcgccgaggtgctgagcagaatggccttcgccccccacggcgaggaccacgacatcgagaagaacgccatcagcgccatgagaatcgtgggcaaggtgaccggcaaggcccccagcaccgaggccagcgacaccgtgcagggcatcgccttcagcggcaaccccctgtacaccagcaccggcgtgctgaccgccaaggacgaccccatctacatctgggcccccggcatcatcatggagggcaaccacagcgtgtgcgagaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcatctgccagagagtggacatggacatcaccgtgtactgcaacggcctgaagaaggtgatcctgaccaagaccttcatcatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctgggtgctgatccccttcttcagcatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacagaaagagctgccccatgggcagctgcccctactgcctgaaccccgccgaggccaccaccagcgccctgcaggcccacttcaaggtgtgcaagctgaccagcagattccaggacaacctgagaaagagcctgggcgcctacgagcccaagcagggctgctacagaaccctgagcctgttcagatacagaagcagattcttcgtgggcttcatctggtgcttcctgctggtgctggagctgatcatctgggccgccagcgccgagacccagaacctgaacagcggctggaccgacaccgcccacggcagcggcgtgatccccatgagaaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacggcaccttcaacctgaagaccgccttccactgctacggcagctgcgagaagtacgcctacccctggcagaccgccggctgcttcatcgagaaggactacgagtacgagagcggctggggctgcaacccccccgactgccccggcgtgggcaccggctgcaccgcctgcggcgtgtacctggacaagctgaagagcgtgggcaaggccttcaagatcgtgagcctgagatacaccagaaaggcctgcatccagctgggcaccgagcagacctgcaagagcgtggacagcaacgactgcctggtgaccaccagcgtgaaggtgtgcctgatcggcaccgtgagcaagttccagcccagcgacaccctgctgttcctgggccccctggagcagggcggcctgatcttcaagcagtggtgcaccaccacctgccacttcggcgaccccggcgacatcatgagcacccccgccggcatgaagtgccccgagctgagcggcagcttcaccaagaagtgcgccttcgcccccacccccgtgtgccagttcgacggcgacaccaccagcggctacaagaagatgatcgccaccaaggacagcttccagagcttcaacgtgaccgagccccacatcagcgccagcagcctggagtggatcgaccccgacagaagcctgagagaccacatcaacgtgatcgtgggcagagacctgagcttccaggacctgagcgagaccccctgccaggtggacctgaccaccaccagcatcgacggcgcctggggcagcggcgtgggcttcaacctgatctgcagcgtgagcctgaccgagtgcagcaccttcctgaccagcatcaaggcctgcgacagcgccatgtgctacggcagcaccaccgccaacctgctgagaggccagaacaccgtgcacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatcagctgctggctgaccaagagcggcgagtggatcctgggcgtgctgaacggcaactggatggtggtggccgtgctggtggccctgttcatcttcagcatcttcctgttcaccctgtgctgccccagaagacccagctacgccaaggagcacaagccctga

SEQ ID NO: 8512 - RNA, 3447 nt, synthetic construct
  misc_feature 1..3447: note = derived and/or modified CDS sequence (opt4) from PUUV(PUUV/Orleans/Mg29/2010)__KT247601.1__GP
  source 1..3447: mol_type = other RNA
atgggcaagatcatccccgtgtgcctgtacctgctgttcagatgcctgctgctgtgggacagaggcaacgccagaaacctgaacgagctgaagatggagtgcccccacaccatcggcctgggccagggcctggtgatcggcagcgtggagctgccccccgtgcccctgacccagatcgagagcctgaagctggagagcagctgcaacttcgacctgcacaccagcaccagcagccagcagagcttcaccaagtggacctgggagatcaagagcgacctggccgagaacacccaggccagcagcaccagcttccagaccaagagcagcgaggtgaacctgagaggcctgtgcctggtgccccccctggtgatcgagaccgccgccagaaccagaaagaccatcgcctgcttcgacctgagctgcaaccagaccgcctgccagcccaccgtgttcctgatcggccccatccagacctgcatcaccaccaagagctgcctgctgggcctgggcgaccagagaatccaggtgaactacgagaagacctactgcgtgagcggccagctggtggagggcgtgtgcttcaaccccatccacaccatggccctgagccagcccagccacacctacgacatcgtgaccgtgatggtgagatgcttcctgatcgtgaagaaggtgagcaccggcgacagcatgaagatcgagaagagcttcgagaccctggtgcagaagaccggctgcaccggcaacggcttccagggctactacgtgtgcctgatcggcagcagcagcgagcccctgtacatccccaccctggacgactacagaagcgccgaggtgctgagcagaatggccttcgccccccacggcgaggaccacgacatcgagaagaacgccatcagcgccatgagaatcgtgggcaaggtgaccggcaaggcccccagcaccgaggccagcgacaccgtgcagggcatcgccttcagcggcaaccccctgtacaccagcaccggcgtgctgaccgccaaggacgaccccatctacatctgggcccccggcatcatcatggagggcaaccacagcgtgtgcgagaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcatctgccagagagtggacatggacatcaccgtgtactgcaacggcctgaagaaggtgatcctgaccaagaccttcatcatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctgggtgctgatccccttcttcagcatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacagaaagagctgccccatgggcagctgcccctactgcctgaaccccgccgaggccaccaccagcgccctgcaggcccacttcaaggtgtgcaagctgaccagcagattccaggacaacctgagaaagagcctgggcgcctacgagcccaagcagggctgctacagaaccctgagcctgttcagatacagaagcagattcttcgtgggcttcatctggtgcttcctgctggtgctggagctgatcatctgggccgccagcgccgagacccagaacctgaacagcggctggaccgacaccgcccacggcagcggcgtgatccccatgagaaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacggcaccttcaacctgaagaccgccttccactgctacggcagctgcgagaagtacgcctacccctggcagaccgccggctgcttcatcgagaaggactacgagtacgagagcggctggggctgcaacccccccgactgccccggcgtgggcaccggctgcaccgcctgcggcgtgtacctggacaagctgaagagcgtgggcaaggccttcaagatcgtgagcctgagatacaccagaaaggcctgcatccagctgggcaccgagcagacctgcaagagcgtggacagcaacgactgcctggtgaccaccagcgtgaaggtgtgcctgatcggcaccgtgagcaagttccagcccagcgacaccctgctgttcctgggccccctggagcagggcggcctgatcttcaagcagtggtgcaccaccacctgccacttcggcgaccccggcgacatcatgagcacccccgccggcatgaagtgccccgagctgagcggcagcttcagaaagaagtgcgccttcgcccccacccccgtgtgccacttcgacggcaagaccatcagcggctacaagagaatgatcgccaccaaggacagcttccagagcttcaacgtgaccgagccccacatcagcgccagcagcctggagtggatcgaccccgacagcagcctgagagaccacatcaacgtgatcgtgggcagagacctgagcttccaggacctgagcgagaccccctgccaggtggacctgaccaccaccagcatcgacggcgcctggggcagcggcgtgggcttcaacctgatctgcagcgtgagcctgaccgagtgcagcaccttcctgaccagcatcaaggcctgcgacagcgccatgtgctacggcagcaccaccgccaacctgctgagaggccagaacaccgtgcacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatcagctgctggctgaccaagagcggcgagtggatcctgggcgtgctgaacggcaactggatggtggtggccgtgctggtggccctgttcatcttcagcatcttcctgttcaccctgtgctgccccagaagacccagctacgccaaggagcacaagccctga

SEQ ID NO: 8513 - RNA, 3447 nt, synthetic construct
  misc_feature 1..3447: note = derived and/or modified CDS sequence (opt4) from PUUV(Vranica)__U14136.1__GP
  source 1..3447: mol_type = other RNA
atgggcaagctgagccccgtgtgcctgtacctgttcctgcagtgcctgctgctgtggaacagaggcagcgccagaaacctgaacgagctgaagatggagtgcccccacaccatcggcctgggccagggcctggtgatcggcagcgtggagctgccccccgtgcccatccagcaggtggagagcctgaagctggagagcagctgcaacttcgacctgcacaccagcaccgccacccagcagagcttcaccaagtggacctgggagatgaaggacgacctggccgagaacacccaggccagcagcaccagcttccagaccaagagcagcgaggtgaacctgagaggcctgtgcctgatcccccccctggtggtggagaccgccagcagaaccagaaagaccatcgcctgcttcgacatcagctgcaaccagaccgtgtgccagcccaccgtgtacctggtgggccccatccagacctgcatcaccaccaagagctgcctgctgggcctgggcgaccagagaatccaggtgaactacgagaagacctactgcgtgagcggccagctgatcgagggcgtgtgcttcaaccccgtgcacaccagagccctgagccagcccagccacacctacgacatcgtgaccatgatggtgagatgcttcctggtggtgaagaaggtgaccagcggcgacagcatgaagatcgagaagaacttcgagaccctggtgcagaagaccgactgcaacgccaacggcttccagggctactacatctgcctggtgggcagcagcagcgagcccctgtacgtgcccaccctggacgactacagaagcgccgaggtgctgagcagaatggccttcgccccccacggcgaggaccacgacgtggagagaaacgccgtgagcgccctgagaatcgtgggcaaggtgaccggcaaggcccccagcaccgaggccagcgacaccgtgcagggcatcgccttcagcggcagccccctgtacaccagcaccggcgtgctgaccgccaaggacaaccccgtgtacatctggagccccggcatcatcatggagggcaaccacagcgtgtgcgagaagaagaccctgcccctgacctggaccggcttcatccccctgcccggcgagatcgagaagaccccccagtgcaccgtgttctgcaccctggccggccccggcgccgactgcgaggcctacagcgagaccggcatcttcaacatcagcagccccacctgcctgctgaacagagtgcagagattcagaggcgccgagcagcagatcaagttcgtgtgccagagagtggacatggacatcaccgtgtactgcaacggcatgaagaaggtgatcctgaccaagaccctggtgatcggccagtgcatctacaccttcaccagcatcttcagcctgatccccggcatcgcccacagcctggccgtggagctgtgcgtgcccggcctgcacggctgggccaccgtgctgctgctgctgaccttctgcttcggctggatcctgatccccttcatcgccatgatcctgctgaagatcctgatcgccttcgcctacctgtgcagcaagtacaacaccgacagcaagttcaagatcctgatcgagaaggtgaagaaggagtaccagaagaccatgggcagcatggtgtgcgaggtgtgccagtacgagtgcgagaccgccaaggagctggagagccacagaaagagctgccccatcggcagctgcccctactgcctgaaccccagcgaggccaccaccagcgccctgcaggcccacttcaaggtgtgcaagctgaccagcagattccaggacaacctgagaaagagcctggccgcctacgagcccaagcagggctgctacagaaccctgagcctgttcagatacagaagcagattcttcgtgggcttcatctggtgcatcctgctggtgctggagctggtgatctgggccgccagcgccgagacccagaacctgaacagcggctggaccgacaccgcccacggcagcggcgtggtgcccatgagaaccgacctggagctggacttcagcctgcccagcagcgccagctacacctacagaagacagctgcagaaccccgccaacgagcacgagaagatccccttccacctgcagatcagcaagcaggtgatccacgccgagatccagcacctgggccactggatggacgccaccttcaacctgaagaccgccttccactgctacggcctgtgcgagaagtacgcctacccctggcagaccgccggctgcttcttcgagaaggactacgagttcgagagcggctggggctgcaacccccccgactgccccggcatcggcaccggctgcaccgcctgcggcgtgtacctggacaagctgaagagcgtgggcaaggtgttcaagatcatcagcctgagatacaccagaaaggcctgcatccagctgggcaccgagcagacctgcaagagcgtggacagcaacgactgcctggtgaccaccagcatcaaggtgtgcctgatcggcaccgtgagcaagttccagcccagcgacaccctgctgttcctgggccccctggagcagggcggcctgatcttcaagcagtggtgcaccaccacctgccagttcggcgaccccggcgacatcatgagcaccctgaccggcatgaagtgccccgagctgaacggcagcttcagaaagaagtgcgccttcgccaccacccccgtgtgccagttcgacggcaacaccatcagcggctacaagagaatgatggccaccaaggacagcttccagagcttcaacgtgaccgagccccacatcagcaccagcgccctggagtggatcgaccccgacagcagcctgagagaccacatcaacgtggtggtgagcagagacctgagcttccaggacctgagcgagaccccctgccaggtggacctgaccaccagcagcatcgacggcgcctggggcagcggcgtgggcttcaacctggtgtgcaccgtgagcctgaccgagtgccccaccttcctgaccagcatcaaggcctgcgacagcgccatgtgctacggcagcaccaccaccaacctggtgagaggccagaacaccgtgcacatcgtgggcaagggcggccacagcggcagcaagttcatgtgctgccacgacaccaagtgcagcagcaccggcctgatcgccgccgccccccacctggacagagtgaccggcttcaaccaggccgacagcgacaagatcttcgacgacggcgcccccggctgcggcatgagctgctggttcaagaagagcggcgagtggatcctgggcgtgctgaacggcaactggctggtggtggccgtgctgatcgccctgttcatcctgagcatcttcctgttcaccctgtgctgccccagaagacccacctacaccaaggagcacaagccctga

SEQ ID NO: 8514 - RNA, 3447 nt, synthetic construct
  misc_feature 1..3447: note = derived and/or modified CDS sequence (opt4) from PUUV(CG1820/POR)__KT885051.1__GP
  source 1..3447: mol_type = other RNA
atgggcgagctgagccccgtgtgcctgtacctgctgctgcagggcctgctgctgtgcaacaccggcgccgccagaaacctgaacgagctgaagatggagtgcccccacaccatcagactgggccagggcctggtggtgggcagcgtggagctgcccagcctgcccatccagcaggtggagaccctgaagctggagagcagctgcaacttcgacctgcacaccagcaccgccggccagcagagcttcaccaagtggacctgggagatcaagggcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcatcaccaccaagagctgcctgctgagcctgggcgaccagagaatccaggtgaactacgagaagacctactgcgtgagcggccagctggtggagggcatctgcttcaaccccatccacaccatggccctgagccagcccagccacacctacgacatcatgaccatgatggtgagatgcttcctggtgatcaagaaggtgaccagcggcgacagcatgaagatcgagaagaacttcgagaccctggtgcagaagaacggctgcaccgccaacaacttccagggctactacatctgcctgatcggcagcagcagcgagcccctgtacgtgcccgccctggacgactacagaagcgccgaggtgctgagcagaatggccttcgccccccacggcgaggaccacgacatcgagaagaacgccgtgagcgccatgagaatcgccggcaaggtgaccggcaaggcccccagcaccgagagcagcgacaccgtgcagggcatcgccttcagcggcagccccctgtacaccagcaccggcgtgctgaccagcaaggacgaccccgtgtacatctgggcccccggcatcatcatggagggcaaccacagcatctgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcagcgagcagcagatcaagttcgtgtgccagagagtggacatggacatcaccgtgtactgcaacggcatgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctgggtgctgatccccaccatcaccatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagctgagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctggccaccgccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctggtgagaggccagaacaccatccacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctggtggtgctgctgatcctgagcatcctgctgttcaccctgtgctgccccagaagacccagctacagaaaggagcacaagccctga

SEQ ID NO: 8515 - RNA, 3447 nt, synthetic construct
  misc_feature 1..3447: note = derived and/or modified CDS sequence (opt4) from PUUV(DTK/Ufa-97)__AB297666.2__GP
  source 1..3447: mol_type = other RNA
atgggcgagctgagccccgtgtgcctgtacctgctgctgcagggcctgctgctgtgcaacaccggcgccgccagaaacctgaacgagctgaagatggagtgcccccacaccgtgagactgggccagggcctggtggtgggcagcgtggagctgcccagcctgcccatccagcaggtggagaccctgaagctggagagcagctgcaacttcgacctgcacaccagcaccgccggccagcagagcttcaccaagtggacctgggagatcaagggcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcatcaccaccaagagctgcctgctgagcctgggcgaccagagaatccaggtgaactacgagaagacctactgcgtgagcggccagctggtggagggcatctgcttcaaccccatccacaccatggccctgagccagcccagccacacctacgacatcatgaccatgatggtgagatgcttcctggtgatcaagaaggtgaccagcggcgacagcatgaagatcgagaagaacttcgagaccctggtgcagaagaacggctgcaccgccaacaacttccagggctactacatctgcctgatcggcagcagcagcgagcccctgtacgtgcccgccctggacgactacagaagcgccgaggtgctgagcagaatggccttcgccccccacggcgaggaccacgacatcgagaagaacgccgtgagcgccatgagaatcgccggcaaggtgaccggcaaggcccccagcaccgagagcagcgacaccgtgcagggcatcgccttcagcggcagccccctgtacaccagcaccggcgtgctgaccagcaaggacgaccccgtgtacatctgggcccccggcatcatcatggagggcaaccacagcatctgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcagcgagcagcagatcaagttcgtgtgccagagagtggacatggacatcaccgtgtactgcaacggcatgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctgggtgctgatccccaccatcaccatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagctgagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctggccaccgccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctggtgagaggccagaacaccatccacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctggtggtgctgctgatcctgagcatcctgctgttcaccctgtgctgccccagaagacccagctacagaaaggagcacaagccctga

SEQ ID NO: 8516 - RNA, 3447 nt, synthetic construct
  misc_feature 1..3447: note = derived and/or modified CDS sequence (opt4) from PUUV(PUU/Cg-Erft)__AJ238778.1__GP
  source 1..3447: mol_type = other RNA
atgggcaagatcatccccgtgtgcctgtacctgctgttcctgtgcctgctgctgtggaacagaggcgacgccagaaacctgaacgagctgaagatcgagtgcccccacaccatcggcctgggccagggcctggtgatcggcagcgtggagctgccccccgtgcccctgacccaggtggagagcctgaagctggagagcagctgcaacttcgacctgcacaccagcaccagcagccagcagcccttcaccaagtggacctgggagatgaagagcgacctggccgagaacacccaggccagcagcaccagcttccagaccaagagcagcgagatcaacctgagaggcctgtgcctggtgccccccctggtgatcgagaccgccgccagaaccagaaagaccatcgcctgcttcgacctgagctgcaaccagaccgcctgccagcccaccgtgttcctgatcggccccatccagacctgcatcaccaccaagagctgcctgctgggcctgggcgaccagagaatccaggtgaactacgagaagacctactgcgtgagcggccagctggtggagggcgtgtgcttcaaccccgtgcacaccatggccctgagccagcccagccacacctacgacatcgtgaccgtgatggtgagatgcttcctgatcgccaagaaggtgagcaccggcgacagcatgaagctggagaagagcttcgagaccctggtgcagaagaccagctgcaccggcaacggcttccagggctactacatctgcctggtgggcagcagcagcgagcccctgtacatccccaccctggacgactacagaagcgccgaggtgctgagcagaatggccttcgccccccacggcgaggaccacgacgtggagaagaacgccatcagcgccatgagaatcatcggcaaggtgaccggcaaggcccccagcaccgagagcagcgacaccatccagggcgtggccttcagcggcaaccccctgtacaccagcaccggcgtgctgaccgccaaggacgaccccgtgtacatctgggcccccggcatcatcatggagggcaaccacagcgtgtgcgacaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcatctgccagagagtggacatggacatcaccgtgtactgcaacggcctgaagaaggtgatcctgaccaagaccctgatcatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctggatcctgatccccttcttcagcatgatcctgctgaagatcctgatcgccttcgcctacctgtgcagcaagtacaacaccgacagcaagttcaagatcctgatcgagaaggtgaagaaggagtaccagaagaccatgggcagcatggtgtgcgaggtgtgccactacgagtgcgagaccgccaaggagctggagagccacagaaagagctgccccatgggcagctgcccctactgcctgaaccccgccgaggccaccaccagcgccctgcaggcccacttcaaggtgtgcaagctgaccagcagattccaggacaacctgagaaagagcctgggcgcctacgagcccaagcagggctgctacagaaccctgagcctgttcagatacagaagcagattcttcgtgggcttcatctggtgcctgctgctggtgctggagctgatcgtgtgggccgccagcgccgagacccagaacctgaacagcggctggaccgacaccgcccacggcagcggcatcatccccatgagaaccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacggcaccttcaacctgaagaccgccttccactgctacggcagctgcgagaagtacgcctacccctggcagaccgccggctgcttcatcgagaaggactacgagtacgagagcggctggggctgcaacccccccgactgccccggcgtgggcaccggctgcaccgcctgcggcgtgtacctggacaagctgaagagcgtgggcaaggccttcaagatcgtgagcctgagatacaccagaaaggcctgcatccagctgggcaccgagcagacctgcaagagcgtggacagcaacgactgcctggtgaccaccagcgtgaaggtgtgcctgatcggcaccgtgagcaagttccagcccagcgacaccctgctgttcctgggccccctggagcagggcggcctgatcttcaagcagtggtgcaccaccacctgccagttcggcgaccccggcgacatcatgagcacccccgtgggcatgaagtgccccgagctgaacggcagcttcagaaagaagtgcgccttcgccaccacccccgtgtgccagttcgacggcaacaccctgagcggctacaagagaatgatcgccaccaaggacagcttccagagcttcaacgtgaccgagccccacatcagcgccagcagcctggagtggatcgaccccgacagcagcctgagagaccacatcaacgtgatcgtgggcagagacctgagcttccaggacctgagcgagaccccctgccaggtggacctggccaccaccagcatcgacggcgcctggggcagcggcgtgggcttcaacctggtgtgcagcgtgagcctgaccgagtgcagcaccttcctgaccagcatcaaggcctgcgacagcgccatgtgctacggcagcaccaccgccaacctgctgagaggccagaacaccgtgcacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatcagctgctggttcaccaagagcggcgagtggatcctgggcgtgctgaacggcaactggatggtggtggccgtgctggtggccctgttcatcctgagcatcttcctgttcaccctgtgctgccccagaagacccagctacgccaaggagcacaagccctga

SEQ ID NO: 8517 - RNA, 3447 nt, synthetic construct
  misc_feature 1..3447: note = derived and/or modified CDS sequence (opt4) from PUUV(PUUV/Konnevesi/Mg_M105A/2005)__JQ319173.1__GP
  source 1..3447: mol_type = other RNA
atgggcaagagcagccccgtgtgcctgtacctgatcctgcagggcctgctgctgatcggcgccgtgaacgccagaaacctgaacgagctgaagatggagtgcccccacaccatcggcctgggccagggcctggtggtgggcagcgtggagctgccccccgtgcccatccagcaggtggagagcctgaagctggagagcagctgcaacttcgacctgcacaccagcaccgccggccagcagagcttcaccaagtggacctgggagaccaagagcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcctgaccaccaagagctgcctgctgggcctgggcgaccagagaatccaggtgaactacgagagaacctactgcgtgagcggccagctggtggagggcgtgtgcttcaaccccatccacaccatggccctgagccagcccagccacacctacgacatcgtgaccgtgatggtgagatgcttcctggtgatcaagaaggtgaccagcggcgacagcatgaagatcgagaagaacttcgagaccctggtgcagaagaccggctgcaccgccaacagcttccagggctactacatctgcctggtgggcagcagcagcgagcccctgtacgtgcccaccctggacgactacagaagcgccgaggtgctgagcagaatggccttcgccccccacggcgaggaccacgacatcgagaagaacgccatcagcgccctgagaatcgccggcaaggtgaccggcaaggcccccagcaccgagagcagcgacaccgtgcagggcatcgccttcagcggcagccccctgtacaccagcaccggcgtgctgaccgccaaggacgaccccgtgtacatctgggcccccggcatcatcatggagggcaaccacagcgtgtgcgagaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcgtgaagaaggtgatcctgaccaagaccctggtgatcggccagtgcatctacaccttcaccagcatcttcagcctgatccccggcatcgcccacagcctggccgtggagctgtgcgtgcccggcctgcacggctgggccaccgtgctgctgctgctgaccttctgcttcggctgggtgctgatccccaccatcaccatgatcctgctgaagatcctgatcgccttcgcctacctgtgcagcaagtacaacaccgacagcaagttcaagatcctggtggagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccacccccagcgccctgcaggcccacttcaaggtgtgcaagctgaccagcagattccaggagaacctgaagaagagcctgaccatgtacgagcccatgcagggctgctacagaaccctgagcctgttcagatacagaagcagattcttcgtgggcctggtgtggtgcatgctgctggtgctggagctgatcgtgtgggccgccagcgccgagacccagaacctgaacgccggctggaccgacaccgcccacggcagcggcatcatccccatgaaggccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcgtggagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctgaccgccagcgccatcgacggcgcctggggcagcggcgtgggcttcaacctggtgtgcaccatcagcctgaccgagtgcagcaccttcctgaccagcatcaaggcctgcgacgccgccatgtgctacggcagcaccaccaccaacctggtgagaggccagaacaccatccacgtggtgggcaagggcggccacagcggcagcaagttcatgtgctgccacgacaccaagtgcagcagcaccggcctggtggccgccgccccccacctgaacagagtgaccggcttcaaccaggccgacagcgacaagatcttcgacgacggcgcccccgagtgcggcgtgagctgctggttcaagaagagcggcgagtgggtgctgggcgtgctgaacggcaactggatggtggtggccgtgctgatcgccctgctgatcctgagcatcttcctgttcgccctgtgctgccccagaagacccagctacaagaaggagcacaagccctga

SEQ ID NO: 8518 - RNA, 3447 nt, synthetic construct
  misc_feature 1..3447: note = derived and/or modified CDS sequence (opt4) from PUUV(PUUV/Konnevesi/Mg_M114B/2005)__JQ319175.1__GP
  source 1..3447: mol_type = other RNA
atgggcaagagcagccccgtgtgcctgtacctgatcctgcagggcctgctgctgttcggcgccgtgaacgccagaaacctgaacgagctgaagatggagtgcccccacaccatcggcctgggccagggcctggtggtgggcagcgtggagctgccccccgtgcccatccagcaggtggagagcctgaagctggagagcagctgcaacttcgacctgcacaccagcaccgccggccagcagagcttcaccaagtggacctgggagatcaagaacgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcctgaccaccaagagctgcctgctgggcctgggcgaccagagaatccaggtgaactacgagagaacctactgcgtgagcggccagctggtggagggcgtgtgcttcaaccccatccacaccatggccctgagccagcccagccacacctacgacatcgtgaccatcatggtgagatgcttcctggtgatcaagaaggtgaccagcggcgacaacatgaagatcgagaagaacttcgagaccctggtgcagaagaccggctgcaccgccaacagcttccagggctactacatctgcctggtgggcagcagcagcgagcccctgtacgtgcccaccctggacgactacagaagcgccgaggtgctgagcagaatggccttcgccccccacggcgaggaccacgacatcgagaagaacgccatcagcgccctgagaatcgccggcaaggtgaccggcaaggcccccagcaccgagagcagcgacaccgtgcagggcatcgccttcagcggcagccccctgtacaccagcaccggcgtgctgaccgccaaggacgaccccgtgtacatctgggcccccggcatcatcatggagggcaaccacagcgtgtgcgagaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcgtgaagaaggtgatcctgaccaagaccctggtgatcggccagtgcatctacaccttcaccagcatcttcagcctgatccccggcatcgcccacagcctggccgtggagctgtgcgtgcccggcctgcacggctgggccaccgtgctgctgctgctgaccttctgcttcggctgggtgctgatccccaccatcaccatgatcctgctgaagatcctgatcgccttcgcctacctgtgcagcaagtacaacaccgacagcaagttcaagatcctggtggagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccacccccagcgccctgcaggcccacttcaaggtgtgcaagctgaccagcagattccaggagaacctgaagaagagcctgaccatgtacgagcccatgcagggctgctacagaaccctgagcctgttcagatacagaagcagattcttcgtgggcctggtgtggtgcatgctgctggtgctggagctgatcgtgtgggccgccagcgccgagacccagaacctgaacgccggctggaccgacaccgcccacggcagcggcatcatccccatgaaggccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcgtggagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctgatcgccagcgccatcgacggcgcctggggcagcggcgtgggcttcaacctggtgtgcaccgtgagcctgaccgagtgcagcaccttcctgaccagcatcaaggcctgcgacgccgccatgtgctacggcagcaccaccatcaacctgatcagaggccagaacaccatccacgtggtgggcaagggcggccacagcggcagcaagttcatgtgctgccacgacaccaagtgcagcagcaccggcctggtggccgccgccccccacctggacagagtgaccggcttcaaccaggccgacagcgacaagatcttcgacgacggcgcccccgagtgcggcgtgagctgctggttcaagaagagcggcgagtgggtgctgggcgtgctgaacggcaactggatggtggtggccgtgctgatcgccctgctgatcctgagcatcttcctgttcgccctgtgctgccccagaagacccagctacaagaaggagcacaagccctga

SEQ ID NO: 8519 - RNA, 3447 nt, synthetic construct
  misc_feature 1..3447: note = derived and/or modified CDS sequence (opt4) from PUUV(PUUV/Konnevesi/Mg_M78B/2005)__JQ319174.1__GP
  source 1..3447: mol_type = other RNA
atgggcaagagcagccccgtgtgcctgtacctgatcctgcagggcctgctgctgttcggcgccgtgaacgccagaaacctgaacgagctgaagatggagtgcccccacaccatcggcctgggccagggcctggtggtgggcagcgtggagctgccccccgtgcccatccagcaggtggagagcctgaagctggagagcagctgcaacttcgacctgcacaccagcaccgccggccagcagagcttcaccaagtggacctgggagatcaagaacgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcctgaccaccaagagctgcctgctgggcctgggcgaccagagaatccaggtgaactacgagagaacctactgcgtgagcggccagctggtggagggcgtgtgcttcaaccccatccacaccatggccctgagccagcccagccacacctacgacatcgtgaccatcatggtgagatgcttcctggtgatcaagaaggtgaccagcggcgacaacatgaagatcgagaagaacttcgagaccctggtgcagaagaccggctgcaccgccaacggcttccagggctactacatctgcctggtgggcagcagcagcgagcccctgtacgtgcccaccctggacgactacagaagcgccgaggtgctgagcagaatggccttcgccccccacggcgaggaccacgacatcgagaagaacgccatcagcgccctgagaatcgccggcaaggtgaccggcaaggcccccagcaccgagagcagcgacaccgtgcagggcatcgccttcagcggcagccccctgtacaccagcaccggcgtgctgaccgccaaggacgaccccgtgtacatctgggcccccggcatcatcatggagggcaaccacagcgtgtgcgagaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccaagcagcagatcaagttcgtgtgccagagagtggacatggacatcaccgtgtactgcaacggcgtgaagaaggtgatcctgaccaagaccctggtgatcggccagtgcatctacaccttcaccagcatcttcagcctgatccccggcatcgcccacagcctggccgtggagctgtgcgtgcccggcctgcacggctgggccaccgtgctgctgctgctgaccttctgcttcggctgggtgctgatccccaccatcaccatgatcctgctgaagatcctgatcgccttcgcctacctgtgcagcaagtacaacaccgacagcaagttcaagatcctggtggagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccacccccagcgccctgcaggcccacttcaaggtgtgcaagctgaccagcagattccaggagaacctgaagaagagcctgaccatgtacgagcccatgcagggctgctacagaaccctgagcctgttcagatacagaagcagattcttcgtgggcctggtgtggtgcatgctgctggtgctggagctgatcgtgtgggccgccagcgccgagacccagaacctgaacgccggctggaccgacaccgcccacggcagcggcatcatccccatgaaggccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcgtggagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacatgaccgccagcgccatcgacggcgcctggggcagcggcgtgggcttcaacctggtgtgcaccgtgagcctgaccgagtgcagcaccttcctgaccagcatcaaggcctgcgacgccgccatgtgctacggcagcaccaccaccaacctggtgagaggccagaacaccatccacgtggtgggcaagggcggccacagcggcagcaagttcatgtgctgccacgacaccaagtgcagcagcaagggcctggtggccgccgccccccacctggacagagtgaccggcttcaaccaggccgacagcgacaagatcttcgacgacggcgcccccgagtgcggcgtgagctgctggttcaagaagagcggcgagtgggtgctgggcgtgctgaacggcaactggatggtggtggccgtgctgatcgccctgctgatcctgagcatcttcctgttcgccctgtgctgccccagaagacccagctacaagaaggagcacaagccctga

SEQ ID NO: 8520 - RNA, 3447 nt, synthetic construct
  misc_feature 1..3447: note = derived and/or modified CDS sequence (opt4) from PUUV(PUUV/Konnevesi/Mg_O78A/2005)__JQ319172.1__GP
  source 1..3447: mol_type = other RNA
atgggcaagagcagccccgtgtgcctgtacctgatcctgcagggcctgctgctgttcggcgccgtgaacgccagaaacctgaacgagctgaagatggagtgcccccacaccatcggcctgggccagggcctggtggtgggcagcgtggagctgccccccgtgcccatccagcaggtggagagcctgaagctggagagcagctgcaacttcgacctgcacaccagcaccgccggccagcagagcttcaccaagtggacctgggagatcaagagcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcctgaccaccaagagctgcctgctgggcctgggcgaccagagaatccaggtgaactacgagagaacctactgcgtgagcggccagctggtggagggcgtgtgcttcaaccccatccacaccatggccctgagccagcccagccacacctacgacatcgtgaccatcatggtgagatgcttcctggtgatcaagaaggtgaccagcggcgacagcatgaagatcgagaagaacttcgagaccctggtgcagaagaccggctgcaccgccaacagcttccagggctactacatctgcctggtgggcagcagcagcgagcccctgtacgtgcccaccctggacgactacagaagcgccgaggtgctgagcagaatggccttcgccccccacggcgaggaccacgacatcgagaagaacgccatcagcgccctgagaatcgccggcaaggtgaccggcaaggcccccagcaccgagagcagcgacaccgtgcagggcatcgccttcagcggcagccccctgtacaccagcaccggcgtgctgaccgccaaggacgaccccgtgtacatctgggcccccggcatcatcatggagggcaaccacagcgtgtgcgagaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcgtgaagaaggtgatcctgaccaagaccctggtgatcggccagtgcatctacaccttcaccagcatcttcagcctgatccccggcatcgcccacagcctggccgtggagctgtgcgtgcccggcctgcacggctgggccaccgtgctgctgctgctgaccttctgcttcggctgggtgctgatccccaccatcaccatgatcctgctgaagatcctgatcgccttcgcctacctgtgcagcaagtacaacaccgacagcaagttcaagatcctggtggagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccacccccagcgccctgcaggcccacttcaaggtgtgcaagctgaccagcagattccaggagaacctgaagaagagcctgaccatgtacgagcccatgcagggctgctacagaaccctgagcctgttcagatacagaagcagattcttcgtgggcctggtgtggtgcatgctgctggtgctggagctgatcgtgtgggccgccagcgccgagacccagaacctgaacgccggctggaccgacaccgcccacggcagcggcatcatccccatgaaggccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcgtggagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctgaccgccagcgccatcgacggcgcctggggcagcggcgtgggcttcaacctggtgtgcaccatcagcctgaccgagtgcagcaccttcctgaccagcatcaaggcctgcgacgccgccatgtgctacggcagcaccaccaccaacctggtgagaggccagaacaccatccacgtggtgggcaagggcggccacagcggcagcaagttcatgtgctgccacgacaccaagtgcagcagcaccggcctggtggccgccgccccccacctgaacagagtgaccggcttcaaccaggccgacagcgacaagatcttcgacgacggcgcccccgagtgcggcgtgagctgctggttcaagaagagcggcgagtgggtgctgggcgtgctgaacggcaactggatggtggtggccgtgctgatcgccctgctgatcctgagcatcttcctgttcgccctgtgctgccccagaagacccagctacaagaaggagcacaagccctga

SEQ ID NO: 8521 - RNA, 3447 nt, synthetic construct
  misc_feature 1..3447: note = derived and/or modified CDS sequence (opt4) from PUUV(PUUV/Pieksamaki/human_kidney/2008)__JN831951.1__GP
  source 1..3447: mol_type = other RNA
atgggcaagagcagccccgtgtgcctgtacctgatcctgcagggcctgctgctgttcggcgccgtgaacgccagaaacctgaacgagctgaagatggagtgcccccacaccatcggcctgggccagggcctggtggtgggcagcgtggagctgccccccgtgcccatccagcaggtggagagcctgaagctggagagcagctgcaacttcgacctgcacaccagcaccgccggccagcagagcttcaccaagtggacctgggagatcaagagcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcctgaccaccaagagctgcctgctgggcctgggcgaccagagaatccaggtgaactacgagagaacctactgcgtgagcggccagctggtggagggcgtgtgcttcaaccccatccacaccatggccctgagccagcccagccacacctacgacgtggtgaccatcatggtgagatgcttcctggtgatcaagaaggtgaccagcggcgacagcatgaagatcgagaagaacttcgagaccctggtgcagaagaccggctgcaccgccaacaacttccagggctactacatctgcctggtgggcagcagcagcgagcccctgtacgtgcccaccctggacgactacagaagcgccgaggtgctgagcagaatggccttcgccccccacggcgaggaccacgacatcgagaagaacgccatcagcgccctgagaatcgccggcaaggtgaccggcaaggcccccagcaccgagagcagcgacaccgtgcagggcatcgccttcagcggcagccccctgtacaccagcaccggcgtgctgaccgccaaggacgaccccgtgtacatctgggcccccggcatcatcatggagggcaaccacagcgtgtgcgagaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcgtgaagaaggtgatcctgaccaagaccctggtgatcggccagtgcatctacaccttcaccagcatcttcagcctgatccccggcatcgcccacagcctggccgtggagctgtgcgtgcccggcctgcacggctgggccaccgtgctgctgctgctgaccttctgcttcggctgggtgctgatccccaccatcaccatgatcctgctgaagatcctgatcgccttcgcctacctgtgcagcaagtacaacaccgacagcaagttcaagatcctggtggagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccacccccagcgccctgcaggcccacttcaaggtgtgcaagctgaccagcagattccaggagaacctgaagaagagcctgaccatgtacgagcccatgcagggctgctacagaaccctgagcctgttcagatacagaagcagattcttcgtgggcctggtgtggtgcatgctgctggtgctggagctgatcgtgtgggccgccagcgccgagacccagaacctgaacgccggctggaccgacaccgcccacggcagcggcatcatccccatgaaggccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcgtggagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctgaccgccagcgccatcgacggcgcctggggcagcggcgtgggcttcaacctggtgtgcaccatcagcctgaccgagtgcagcaccttcctgaccagcatcaaggcctgcgacgccgccatgtgctacggcagcaccaccaccaacctggtgagaggccagaacaccatccacgtggtgggcaagggcggccacagcggcagcaagttcatgtgctgccacgacaccaagtgcagcagcaccggcctggtggccgccgccccccacctggacagagtgaccggcttcaaccaggccgacagcgacaagatcttcgacgacggcgcccccgagtgcggcgtgagctgctggttcagaaagagcggcgagtgggtgctgggcgtgctgaacggcaactggatggtggtggccgtgctgatcgccctgctgatcctgagcatcttcctgttcgccctgtgctgccccagaagacccagctacaagaaggagcacaagccctga

SEQ ID NO: 8522 - RNA, 3447 nt, synthetic construct
  misc_feature 1..3447: note = derived and/or modified CDS sequence (opt4) from PUUV(Samara_49/CG/2005)__AB433850.2__GP
  source 1..3447: mol_type = other RNA
atgggcaagctgagccccgtgtgcctgtacctgctgctgcagggcctgctgctgtgcaagaccggcaccgccagaaacctgaacgagctgaagatggagtgcccccacaccatcggcctgggccagggcctggtggtgggcagcgtggagctgccccccgtgcccatccagcaggtggagaccctgaagctggagagcagctgcaacttcgacctgcacaccagcaccgccggccagcaggccttcaccaagtggacctgggagatcaagggcgacctggccgagaacacccaggccagcagcaccagcttccagaccaagagcagcgaggtgaacctgagaggcctgtgcctgatccccaccctggtgatcgagaccgccgccagaatgagaaagaccatcgcctgctacgacctgagctgcaaccagaccgtgtgccagcccaccgtgtacctgatgggccccatccagacctgcatcaccaccaagagctgcctgctgggcctgggcgaccagagaatccaggtgaactacgagaagacctactgcgtgagcggccagctggtggagggcgtgtgcttcaaccccatccacaccatggccctgagccagcccagccacacctacgacatcgtgaccatgatggtgagatgcttcctggtgatcaagaaggtgaccagcggcgacagcatgaagatcgagaagaacttcgagaccctggtgcagaagaacggctgcaccgccaacagcttccagggctactacatctgcctgatcggcagcagcagcgagcccctgtacgtgcccaccctggacgactacagaagcgccgaggtgctgagcagaatggccttcgccccccacggcgaggaccacgacgtggagaagaacgccatcagcgccctgagaatcgccggcaaggtgaccggcaaggcccccagcaccgagagcagcgacaccgtgcagggcatcgccttcagcggcagccccctgtacaccagcaccggcgtgctgaccgccaaggacgaccccgtgtacatctgggcccccggcatcatcatggagggcaaccacagcgtgtgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcgtgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctgggtgctgatccccaccatcaccatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacaagaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaacatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcgtggagaaggactacgagtacgagaccggctggggctgcaacccccccgactgccccggcgtgggcaccggctgcaccgcctgcggcgcctacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgacctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcgccagcgccctggagtggatcgaccccgacagcagcctgagagaccacatcaacgtgatcgtgagcagagacctgagcttccaggacctgagcgagaccccctgccagatcgacctgagcaccgccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctgatcagaggccagaacaccatccacatcgtgggcaagggcggccacagcggcagcaagttcatgtgctgccacgacaccaagtgcagcaccaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctgatcgccctgctggtgctgagcatcctgctgttcaccctgtgctgccccagaagacccagctacagaaaggagcacaagccctga

SEQ ID NO: 8523 - RNA, 3447 nt, synthetic construct
  misc_feature 1..3447: note = derived and/or modified CDS sequence (opt4) from PUUV(Samara_94/CG/2005)__AB433852.2__GP
  source 1..3447: mol_type = other RNA
atgggcaagctgagccccgtgtgcctgtacctgctgctgcagggcctgctgctgtgcaacaccggcaccgccagaaacctgaacgagctgaagatcgagtgcccccacaccatcggcctgggccagggcctggtggtgggcagcgtggagctgccccccgtgcccatccagcaggtggagaccctgaagctggagagcagctgcaacttcgacctgcacaccagcaccgccggccagcaggccttcaccaagtggacctgggagatcaagggcgacctggccgagaacacccaggccagcagcaccagcttccagaccaagagcagcgaggtgaacctgagaggcctgtgcctgatccccaccctggtgatcgagaccgccgccagaatgagaaagaccatcgcctgctacgacctgagctgcaaccagaccgtgtgccagcccaccgtgtacctgatgggccccatccagacctgcatcaccaccaagagctgcctgctgggcctgggcgaccagagaatccaggtgaactacgagaagacctactgcgtgagcggccagctggtggagggcgtgtgcttcaaccccatccacaccatggccctgagccagcccagccacacctacgacatcgtgaccatgatggtgagatgcttcctgatcatcaagaaggtgaccagcggcgacagcatgaagatcgagaagaacttcgagaccctggtgcagaagaacgactgcaccgccaacagcttccagggctactacatctgcttcatcggcagcagcagcgagcccctgtacgtgcccaccctggacgactacagaagcgccgaggtgctgagcagaatggccttcgccccccacggcgaggaccacgacgtggagaagaacgccatcagcgccctgagaatcgccggcaaggtgaccggcaaggcccccagcaccgagagcagcgacaccgtgcagggcatcgccttcagcggcagccccctgtacaccagcaccggcgtgctggccgccaaggacgaccccgtgtacatctgggcccccggcatcatcatggagggcaaccacagcatctgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcgtgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctgggtgctgatccccaccatcaccatgatcctgctgaagatcctgatcgccttcgcctacctgtgcagcaagtacaacaccgacagcaagttcagaatcctgatcgagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaacatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcgtggagaaggactacgagtacgagaccggctggggctgcaacccccccgactgccccggcgtgggcaccggctgcaccgcctgcggcgcctacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgacctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcgccagcgccctggagtggatcgaccccgacagcagcctgagagaccacatcaacgtgatcgtgagcagagacctgagcttccaggacctgagcgagaccccctgccagatcgacctgagcaccaccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctgatcagaggccagaacaccatccacatcgtgggcaagggcggccacagcggcagcaagttcatgtgctgccacgacaccaagtgcagcaccaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctgatcgccctgctggtgctgagcatcctgctgttcaccctgtgctgccccagaagacccagctacagaaaggagcacaagccctga

SEQ ID NO: 8524 - RNA, 3447 nt, synthetic construct
  misc_feature 1..3447: note = derived and/or modified CDS sequence (opt4) from PUUV(Sotkamo)__NC_005223.1__GP
  source 1..3447: mol_type = other RNA
atgggcaagagcagccccgtgtgcctgtacctgatcctgcagggcctgctgctgttcgacaccgtgaacgccaagaacctgaacgagctgaagatggagtgcccccacaccatcggcctgggccagggcctggtggtgggcagcgtggagctgccccccgtgcccatccagcagatcgagagcctgaagctggagagcagctgcaacttcgacctgcacaccagcaccgccggccagcagagcttcaccaagtggacctgggagaccaagggcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcctgaccaccaagagctgcctgctgggcctgggcgaccagagaatccaggtgaactacgagagaacctactgcgtgagcggccagctggtggagggcgtgtgcttcaaccccatccacaccatggccctgagccagcccagccacacctacgacatcgtgaccatcatggtgagatgcttcctggtgatcaagaaggtgaccagcggcgacagcatgaagatcgagaagaacttcgagaccctggtgcagaagaccggctgcaccgccaacggcttccagggctactacatctgcctgatcggcagcagcagcgagcccctgtacgtgcccaccctggacgactacagaagcgccgaggtgctgagcagaatggccttcgccccccacggcgaggaccacgacatcgagaagaacgccgtgagcgccctgagaatcgccggcaaggtgaccggcaaggcccccagcaccgagagcagcgacaccgtgcagggcatcgccttcagcggcagccccctgtacaccagcaccggcgtgctgaccgccaaggacgaccccgtgtacgtgtgggcccccggcatcatcatggagggcaaccacagcgtgtgcgagaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcgtgaagaaggtgatcctgaccaagaccctggtgatcggccagtgcatctacaccttcaccagcatcttcagcatgatccccggcatcgcccacagcctggccgtggagctgtgcgtgcccggcctgcacggctgggccaccgtgctgctgctgctgaccttctgcttcggctgggtgctgatccccaccatcaccatgatcctgctgaagatcctgatcgccttcgcctacctgtgcagcaagtacaacaccgacagcaagttcagaatcctggtggagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccacccccagcgccctgcaggcccacttcaaggtgtgcaagctgaccagcagattccaggagaacctgaagaagagcctgaccatgtacgagcccatgcagggctgctacagaaccctgagcctgttcagatacagaagcagattcttcgtgggcctggtgtggtgcatgctgctggtgctggagctgatcgtgtgggccgccagcgccgagacccagaacctgaacgacggctggaccgacaccgcccacggcagcggcatcatccccatgaaggccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcgtggagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccggccagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatggtggccaccaaggacagcttccagagcttcaacgtgaccgagccccacatcagcaccagcgccctggagtggatcgacctggacagcagcctgagagaccacatcaacgtgatcgtgagcagagacctgagcttccaggacctgagcgagaccccctgccaggtggacctgaccaccagcgccaccgacggcgcctggggcagcggcgtgggcttcaacctggtgtgcaccgtgagcctgaccgagtgcagcgccttcctgaccagcatcaaggcctgccacgccgccatgtgctacggcagcaccaccaccaacctggtgagaggccagaacaccatccacgtggtgggcaagggcggccacagcggcagcaagttcatgtgctgccacgacaccaagtgcagcagcaccggcctggtggccgccgccccccacctggacagagtgaccggcttcaaccaggccgacagcgacaagatcttcgacgacggcgcccccgagtgcggcatgagctgctggttcaagaagctgggcgagtgggtgctgggcgtgctgaacggcaactggatggtggtggccgtgctgatcgccctgctgatcctgagcatcttcctgttcgccctgtgctgccccagaagacccagctacaagaaggaccacaagccctga

SEQ ID NO: 8525 - RNA, 3447 nt, synthetic construct
  misc_feature 1..3447: note = derived and/or modified CDS sequence (opt4) from PUUV(2009)__HE801634.1__GP
  source 1..3447: mol_type = other RNA
atgggcaagagcagccccgtgtgcctgtacctgatcctgcagggcctgctgctgttcgacaccgtgaacgccagaaacctgaacgagctgaagatggagtgcccccacaccatcggcctgggccagggcctggtggtgggcagcgtggagctgccccccgtgcccatccagcagatcgagagcctgaagctggagagcagctgcaacttcgacctgcacaccagcaccgccggccagcagagcttcaccaagtggacctgggagaccaagggcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcctgaccaccaagagctgcctgctgggcctgggcgaccagagaatccaggtgaactacgagagaacctactgcgtgagcggccagctggtggagggcgtgtgcttcaaccccatccacaccatggccctgagccagcccagccacacctacgacatcgtgaccatcatggtgagatgcttcctggtgatcaagaaggtgaccagcggcgacagcatgaagatcgagaagaacttcgagaccctggtgcagaagaccggctgcaccgccaacggcttccagggctactacatctgcctgatcggcagcagcagcgagcccctgtacgtgcccaccctggacgactacagaagcgccgaggtgctgagcagaatggccttcgccccccacggcgaggaccacgacatcgagaagaacgccgtgagcgccctgagaatcgccggcaaggtgaccggcaaggcccccagcaccgagagcagcgacaccgtgcagggcatcgccttcagcggcagccccctgtacaccagcaccggcgtgctgaccgccaaggacgaccccgtgtacgtgtgggcccccggcatcatcatggagggcaaccacagcgtgtgcgagaagaagaccctgcccctgacctggaccggcttcatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcgtgaagaaggtgatcctgaccaagaccctggtgatcggccagtgcatctacaccttcaccagcatcttcagcctgatccccggcatcgcccacagcctggccgtggagctgtgcgtgcccggcctgcacggctgggccaccgtgctgctgctgctgaccttctgcttcggctgggtgctgatccccaccatcaccatgatcctgctgaagatcctgatcgccttcgcctacctgtgcagcaagtacaacaccgacagcaagttcaagatcctggtggagaaggtgaagaaggagtaccagaagaccatgggcagcatggtgtgcgaggtgtgccagtacgagtgcgagaccgccaaggagctggagagccacagaaagagctgcagcatcggcagctgcccctactgcctgaaccccagcgaggccacccccagcgccctgcaggcccacttcaaggtgtgcaagctgaccagcagattccaggagaacctgaagaagagcctgaccatgtacgagcccatgcagggctgctacagaaccctgagcctgttcagatacagaagcagattcttcgtgggcctggtgtggtgcatgctgctggtgctggagctgatcgtgtgggccgccagcgccgagacccagaacctgaacgccggctggaccgacaccgcccacggcagcggcatcatccccatgaaggccgacctggagctggacttcagcctgcccagcagcgccagctacacctacagaagacagctgcagaaccccgccaacgagcaggagaagatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcgtggagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatggtggccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccaggtggacctgaccaccagcgccatcgacggcgcctggggcagcggcgtgggcttcaacctggtgtgcaccgtgagcctgaccgagtgcagcgccttcctgaccagcatcaaggcctgcgacgccgccatgtgctacggcagcaccaccaccaacctggtgagaggccagaacaccatccacgtggtgggcaagggcggccacagcggcagcaagttcatgtgctgccacgacaccaagtgcagcagcaccggcctggtggccgccgccccccacctggacagagtgaccggcttcaaccaggccgacagcgacaagatcttcgacgacggcgcccccgagtgcggcatgagctgctggttcaagaagctgggcgagtgggtgctgggcgtgctgaacggcaactggatggtggtggccgtgctgatcgccctgctgatcctgagcatcttcctgttcgccctgtgctgccccagaagacccagctacaagaaggagcacaagccctga

SEQ ID NO: 8526 - RNA, 3447 nt, synthetic construct
  misc_feature 1..3447: note = derived and/or modified CDS sequence (opt4) from PUUV(Umea/hu)__AY526218.1__GP
  source 1..3447: mol_type = other RNA
atgggcaagctgagccccgtgtgcctgtacctgttcctgcagtgcctgctgctgtggagcagaggcagcgccagaaacctgaacgagctgaagatggagtgcccccacaccatcggcctgggccagggcctggtgatcggcagcgtggagctgccccccgtgcccgtgcagcaggtggagagcctgaagctggagagcagctgcaacttcgacctgcacaccagcaccgccacccagcagagcttcaccaagtggacctgggagatgaaggacgacctggccgagaacacccaggccagcagcaccagcttccagaccaagagcagcgaggtgaacctgagaggcctgtgcctgatcccccccctggtggtggagaccgccagcagaaccagaaagaccatcgcctgcttcgacatcagctgcaaccagaccgtgtgccagcccaccgtgtacctggtgggccccatccagacctgcatcaccaccaagagctgcctgctgggcctgggcgaccagagaatccaggtgaactacgagaagacctactgcgtgagcggccagctggtggagggcgtgtgcttcaaccccgtgcacaccatggtgctgagccagcccagccacacctacgacatcgtgaccatgatggtgagatgcttcctggtggtgaagaaggtgaccagcggcgacagcatgaagatcgagaagaacctggagaccctggtgcagaagaccgactgcaacgccaacggcttccagggctactacatctgcctggtgggcagcagcagcgagcccctgtacgtgcccaccctggacgactacagaagcgccgaggtgctgagcagaatggccttcgccccccacggcgaggaccacgacatcgagagaaacgccgtgagcgccctgagaatcgtgggcaaggtgaccggcaaggcccccagcaccgaggccagcgacaccatccagggcatcgccttcagcggcagccccctgtacaccagcaccggcgtgctgaccgccaaggacaaccccgtgtacgtgtggagccccggcatcatcatggagggcaaccacagcgtgtgcgagaagaagaccctgcccctgacctggaccggcttcatccccctgcccggcgagatcggcaagaccagccagtgcaccgtgttctgcaccctggccggccccggcgccgactgcgaggcctacagcgagaccggcatcttcaacatcagcagccccacctgcctgatcaacagagcccagagattcagaggcgccgagcagcagatcaagttcgtgtgccagagagtggacatggacatcaccgtgtactgcaacggcatgaagaaggtgatcctgaccaagaccctggtgatcggccagtgcatctacaccttcaccagcatcttcagcctgatccccggcatcgcccacagcctggccgtggagctgtgcgtgcccggcctgcacggctgggccaccgtgctgctgctgctgaccttctgcttcggctggatcctgatccccttcatcgccatgatcagcctgaagatcctgatcgccttcgcctacctgtgcagcaagtacaacaccgacagcaagttcaagatcctgatcgagaaggtgaagaaggagtaccagaagaccatgggcagcatggtgtgcgaggtgtgccagtacgagtgcgagaccgccaaggagctggagagccacagaaagagctgccccatcggcagctgcccctactgcctgaaccccagcgaggccaccaccagcgccctgcaggcccacttcaaggtgtgcaagctgaccagcagagtgcaggacaacctgagaaagagcctggccgcctacgagcccaagcagggctgctacagaaccctgagcctgttcagatacagaagcagattcttcgtgggcttcatctggtgcatcctgctggtgctggagctgatcatctgggccgccagcgccgagacccagaacctgaacagcggctggaccgacaccgcccacggcagcggcatcatccccatgagaaccgacctggagctggacttcagcctgcccagcagcgccagctacacctacagaagacagctgcagaaccccgccaacgagcacgagaagatccccttccacctgcagatcagcaagcaggtgatccacgccgagatccagcacctgggccactggatggacgccaccttcaacctgaagaccgccttccactgctacggcagctgcgagaagtacgcctacccctggcagaccgccggctgcttcttcgagaaggactacgagttcgagagcagctggggctgcaacccccccgactgccccggcgtgggcaccggctgcaccgcctgcggcgtgtacctggacaagctgaagagcgtgggcaaggtgttcaagatcatcagcctgagatacaccagaaaggcctgcatccagctgggcaccgagcagacctgcaagagcgtggacagcaacgactgcctggtgaccaccagcgtgaaggtgtgcctgatcggcaccgtgagcaagttccagcccagcgacaccctgctgttcctgggccccctggagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgacccccacatcagcaccagcgccctggagtggatcgaccccgacagcagcctgagagaccacatcaacgtggtggtgagcagagacctgagcttccaggacctgagcgagaccccctgccaggtggacctgaccaccagcagcatcgacggcgcctggggcagcggcgtgggcttcaacctggtgtgcaccgtgagcctgaccgagtgcagcaccttcctgaccagcatcaaggcctgcgacagcgccatgtgctacggcagcaccaccatcaacctgatgagaggccagaacaccgtgcacatcgtgggcaagggcggccacagcggcagcaagttcatgtgctgccacgacaccaagtgcagcagcaccggcctggtggccgccgccccccacctggacagagtgaccggcttcaaccaggccgacagcgacaagatcttcgacgacggcgcccccgagtgcggcatgagctgctggttcaagaagagcggcgagtggatcctgggcgtgctgaacggcaactggctggtggtggccgtgctggtggccctgttcatcctgagcatcttcctgttcaccctgtgctgccccagaagacccatctacgccaaggagcacaagccctga

SEQ ID NO: 8527 - RNA, 3447 nt, synthetic construct
  misc_feature 1..3447: note = derived and/or modified CDS sequence (opt4) from PUUV(P360)__L08755.1__GP
  source 1..3447: mol_type = other RNA
atgggcgagctgagccccgtgtgcctgtgcctgctgctgcagggcctgctgctgtgcaacaccggcgccgccagaaacctgaacgagctgaagatggagtgcccccacaccatcagactgggccagggcctggtggtgggcagcgtggagctgcccagcctgcccatccagcaggtggagaccctgaagctggagagcagctgcaacttcgacctgcacaccagcaccgccggccagcagagcttcaccaagtggacctgggagatcaagggcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcatcaccaccaagagctgcctgctgagcctgggcgaccagagaatccaggtgaactacgagaagacctactgcgtgagcggccagctggtggagggcatctgcttcaaccccatccacaccatggccctgagccagcccagccacacctacgacatcatgaccatgatggtgagatgcttcctggtgatcaagaaggtgaccagcggcgacagcatgaagatcgagaagaacttcgagaccctggtgcagaagaacggctgcaccgccaacaacttccagggctactacatctgcctgatcggcagcagcagcgagcccctgtacgtgcccgccctggacgactacagaagcgccgaggtgctgagcagaatggccttcgccccccacggcgaggaccacgacatcgagaagaacgccgtgagcgccatgagaatcgccggcaaggtgaccggcaaggcccccagcaccgagagcagcgacaccgtgcagggcatcgccttcagcggcagccccctgtacaccagcaccggcgtgctgaccagcaaggacgaccccgtgtacatctgggcccccggcatcatcatggagggcaaccacagcatctgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcagcgagcagcagatcaagttcgtgtgccagagagtggacatggacatcaccgtgtactgcaacggcatgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccttctgcttcggctgggtgctgatccccaccatcaccatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagctgagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctggccaccgccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctggtgagaggccagaacaccatccacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctggtggtgctgctgatcctgagcatcctgctgttcaccctgtgctgccccagaagacccagctacagaaaggagcacaagccctga

SEQ ID NO: 8528 - RNA, 3447 nt, synthetic construct
  misc_feature 1..3447: note = derived and/or modified CDS sequence (opt4) from MUV(11-1)__JX028272.1__GP
  source 1..3447: mol_type = other RNA
atgggcaagatcagccccgtgtacctgtacctgctgttccagggcctgctgctgtggagagacggcctggccagaaacctgaacgagctgaagatggagtgcccccacaccatcggcctgggccagggcctggtgatcggcagcgtggagctgccccccgtgcccctgagacaggtggagagcctgaagctggagagcagctgcaacttcgacctgcacaccagcaccgccacccagcagagcttcaccaagtggatctgggagagcaagaacgacctgaccgacagcacccaggccagcagcaccagctaccagaccaagagcaccgaggtgaacctgaagggcctgtgcctggtgcccaccctggtgatcgagaccgccgccagaaccagaaagaccatcgcctgcttcgacctgagctgcaaccagaccgtgtgccagcccaccgtgtacctgatcggccccatccagacctgcatcaccaccaagagctgcctgatcggcctgggcgaccagagaatccaggtgaactacgagaagacctactgcgtgagcggccagctggtggagggcgtgtgcttcaaccccatccacaccatggccctgagccagcccagccacacctacgacgtggtgaccatgatggtgagatgcttcctggtggtgaagaaggtgaccagcggcgacagcatgaagatcgagaagaacttcgagaccctggtgcagaagaccggctgcagcaacaacaacttccagggctactacgtgtgcctgatcggcagcagcagcgagcccctgtacgtgcccaccctggacgactacagaagcgccgagatcctgagcagaatggccttcgccccccacggcgaggaccacgacatcgagagaaacgccatcagcgccatgagaatcgtgggcaaggtgaccggcaaggcccccagcagcgagagcagcgacaccgtgcagggcgtggccttcagcggcaaccccctgtacaccagcaccggcgtgctgaccagcaaggacgaccccgtgtacgtgtgggcccccggcatcatcatggagggcaaccacagcgtgtgcgacaagaagaccctgcccctgacctggaccggctacatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcatcaagaaggtgatcctgaccaagaccctggtgatcggccagtgcatctacaccttcaccagcatcttcagcctgatgcccggcgtggcccacagcctggccgtggagctgtgcgtgcccggcctgcacggctgggccaccatgctgctgctgctgaccttctgcttcggctggatcctgatccccaccatcaccctgatcctgctgaagatcctgctggccttcgcctacgtgtgcagcaagtacaacaccgacagcaagttcaagatcctgatcgagaaggtgaagcaggagtaccagaagaccatgggcagcatggtgtgcgaggtgtgccagcacgagtgcgagaccgccaaggagctggagagccacaagaagagctgccccatcggcagctgcccctactgcctgaaccccgccgaggccaccaccagcgccctgcaggcccacttcaaggtgtgcaagctgaccagcagattccaggagaacctgagaaagagcctgaccgtgtacgagcccaagcagggctgctacagaaccctgagcctgttcagatacagaagcagatgcttcgtgggcctgatctggtgcatcctgctgaccctggagctgatcgtgtgggccgccagcgccgagaccctgaacctgaaccccggctggaccgacaccgcccacggcagcggcatcgtgcccatgaagaccgacctggagctggacttcagcctgcccagcagcgccagctacacctacagaagaagcctgcagaaccccgccaacgagcaggagcaggtgcccttccacctgcagatcgagaagcaggtgatccacgccgagatccagcacctgggccactggatggacgccaccttcaacctgaagaccgccttccactgctacggcgcctgcgagaagtacgcctacccctggcagaccgccggctgcttcgtggagaaggacttcgagttcgagaacggctggggctgcaacccccccgactgccccggcgtgggcaccggctgcaccgcctgcggcgcctacctggacaagctgaagagcgtgggcaaggtgttcaagatcgtgagcctgagatacaccagaaaggcctgcatccagctgggcaccgagcagacctgcaagaacgtggacagcaacgactgcctggtgaccaccagcgtgaaggtgtgcctgatcggcaccatcagcaagttccagcccagcgacaccctgctgttcctgggccccctggagcagggcggcatcatcttcaagcagtggtgcaccaccacctgccagttcggcgaccccggcgacatcatgagcacccccatcggcatgaagtgccccgagctgaacggcagcttcagaaagaagtgcagcttcgccaccacccccgtgtgccagttcgacggcaacaccatcagcggctacaagagaatgatcgccaccaaggacagcttccagagcttcaacgtgaccgagccccacatcagcgccagcgccctggagtggatcgaccccgacagcagcctgagagaccacatcaacgtggtggtgggcagagacctgcccttccaggacctgagcgagaccccctgccagatcgacctgagcaccagcagcatcgacggcgcctggggcagcggcgtgggcttcaacctggtgtgcagcgtgagcctgaccgagtgcttcaccttcctgaacagcatcaaggcctgcgacaccgccatgtgctacggcagcaccaccgccaacctggtgagaggccagaacaccgtgcacgtggtgggcaagggcggccacagcggcagcaagttcatgtgctgccacgacaccaagtgcagcaacaccggcctgctggccgccgccccccacctggacagagtgaccggctacaaccaggccgacagcgacaaggtgttcgacgacggcgcccccgagtgcggcatgacctgctggttcaagaagagcggcgagtggatcatgggcgtgctgagcggcaactggatggtggtggccgtgctgatcaccctgctggtgctgagcatcttcctgttcgccctgtgctgccccagaagagccgcctacaagaaggagcacaagccctga

SEQ ID NO: 8529 - RNA, 3447 nt, synthetic construct
  misc_feature 1..3447: note = derived and/or modified CDS sequence (opt4) from MUV(11-4)__JX046483.1__GP
  source 1..3447: mol_type = other RNA
atgggcaagatcagccccgtgtacctgtgcctgctgctgcagggcctgctgctgtggagagacggcctggccagaaacctgaacgagctgaagatggagtgcccccacaccatcggcctgggccagggcctggtgatcggcagcgtggagctgccccccgtgcccctgagacaggtggagagcctgaagctggagagcagctgcaacttcgacctgcacaccagcaccgccacccagcagagcttcaccaagtggatctgggagagcaagaacgacctgaccgacagcacccaggccagcagcaccagctaccagaccaagagcaccgaggtgaacctgaagggcctgtgcctggtgcccaccctggtgatcgagaccgccgccagaaccagaaagaccatcgcctgcttcgacctgagctgcaaccagaccgtgtgccagcccaccgtgtacctgatcggccccatccagacctgcatcaccaccaagagctgcctgatcggcctgggcgaccagagaatccaggtgaactacgagaagacctactgcgtgagcggccagctggtggagggcgtgtgcttcaaccccatccacaccatggccctgagccagcccagccacacctacgacgtggtgaccatgatggtgagatgcttcctggtggtgaagaaggtgaccagcggcgacagcatgaagatcgagaagaacttcgagaccctggtgcagaagaccggctgcagcaacaacaacttccagggctactacgtgtgcctgatcggcagcagcagcgagcccctgtacgtgcccaccctggacgactacagaagcgccgagatcctgagcagaatggccttcgccccccacggcgaggaccacgacatcgagagaaacgccatcagcgccatgagaatcgtgggcaaggtgaccggcaaggcccccagcagcgagagcagcgacaccgtgcagggcatcgccttcagcggcaaccccctgtacaccagcaccggcgtgctgaccagcaaggacgaccccgtgtacgtgtgggcccccggcatcatcatggagggcaaccacagcgtgtgcgacaagaagaccctgcccctgacctggaccggctacatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcatcaagaaggtgatcctgaccaagaccctggtgatcggccagtgcatctacaccttcaccagcatcttcagcctgatgcccggcgtggcccacagcctggccgtggagctgtgcgtgcccggcctgcacggctgggccaccatgctgctgctgctgaccttctgcttcggctggatcctgatccccaccatcaccctgatcctgctgaagatcctgctggccttcgcctacgtgtgcagcaagtacaacaccgacagcaagttcaagatcctgatcgagaaggtgaagcaggagtaccagaagaccatgggcagcatggtgtgcgaggtgtgccagcacgagtgcgagaccgccaaggagctggagagccacaagaagagctgccccatcggcagctgcccctactgcctgaaccccgccgaggccaccaccagcgccctgcaggcccacttcaaggtgtgcaagctgaccagcagattccaggagaacctgagaaagagcctgaccgtgtacgagcccaagcagggctgctacagaaccctgagcctgttcagatacagaagcagatgcttcgtgggcctgatctggtgcatcctgctgaccctggagctgatcgtgtgggccgccagcgccgagaccctgaacctgaaccccggctggaccgacaccgcccacggcagcggcatcgtgcccatgagaaccgacctggagctggacttcagcctgcccagcagcgccagctacacctacagaagaagcctgcagaaccccgccaacgagcaggagcagatccccttccacctgcagatcgagaagcaggtgatccacgccgagatccagcacctgggccactggatggacgccaccttcaacctgaagaccgccttccactgctacggcgcctgcgagaagtacgcctacccctggcagaccgccggctgcttcgtggagaaggacttcgagttcgagaacggctggggctgcaacccccccgactgccccggcgtgggcaccggctgcaccgcctgcggcgcctacctggacaagctgaagagcgtgggcaaggtgttcaagatcgtgagcctgagatacaccagaaaggcctgcatccagctgggcaccgagcagacctgcaagaacgtggacagcaacgactgcctggtgaccaccagcgtgaaggtgtgcctgatcggcaccatcagcaagttccagcccagcgacaccctgctgttcctgggccccctggagcagggcggcatcatcttcaagcagtggtgcaccaccacctgccagttcggcgaccccggcgacatcatgagcacccccatcggcatgaagtgccccgagctgaacggcagcttcagaaagaagtgcagcttcgccaccacccccgtgtgccagttcgacggcaacaccatcagcggctacaagagaatgatcgccaccaaggacagcttccagagcttcaacgtgaccgagccccacatcagcgccagcgccctggagtggatcgaccccgacagcagcctgagagaccacatcaacgtggtggtgggcagagacctgcccttccaggacctgagcgagaccccctgccagatcgacctgagcaccagcagcatcgacggcgcctggggcagcggcgtgggcttcaacctggtgtgcagcgtgagcctgaccgagtgcagcaccttcctgaccagcatcaaggcctgcgacaccgccatgtgctacggcagcaccaccgccaacctggtgagaggccagaacaccgtgcacgtggtgggcaagggcggccacagcggcagcaagttcgtgtgctgccacgacaccaagtgcagcaacaccggcctgctggccgccgccccccacctggacagagtgaccggctacaaccaggccgacagcgacaaggtgttcgacgacggcgcccccgagtgcggcatgacctgctggttcaagaagagcggcgagtggatcatgggcgtgctgagcggcaactggatggtggtggccgtgctgatcaccctgctggtgctgagcatcttcctgttcgccctgtgctgccccagaagagccgcctacaagaaggagcacaagccctga

SEQ ID NO: 8530 - RNA, 3447 nt, synthetic construct
  misc_feature 1..3447: note = derived and/or modified CDS sequence (opt4) from MUV(11-5)__JX046486.1__GP
  source 1..3447: mol_type = other RNA
atgggcaagatcagccccgtgtacctgtgcctgctgctgcagggcctgctgctgtggagagacggcctggccagaaacctgaacgagctgaagatggagtgcccccacaccatcggcctgggccagggcctggtgatcggcagcgtggagctgccccccgtgcccctgagacaggtggagagcctgaagctggagagcagctgcaacttcgacctgcacaccagcaccgccacccagcagagcttcaccaagtggatctgggagagcaagaacgacctgaccgacagcacccaggccagcagcaccagctaccagaccaagagcaccgaggtgaacctgaagggcctgtgcctggtgcccaccctggtgatcgagaccgccgccagaaccagaaagaccatcgcctgcttcgacctgagctgcaaccagaccgtgtgccagcccaccgtgtacctgatcggccccatccagacctgcatcaccaccaagagctgcctgatcggcctgggcgaccagagaatccaggtgaactacgagaagacctactgcgtgagcggccagctggtggagggcgtgtgcttcaaccccatccacaccatggccctgagccagcccagccacacctacgacgtggtgaccatgatggtgagatgcttcctggtggtgaagaaggtgaccagcggcgacagcatgaagatcgagaagaacttcgagaccctggtgcagaagaccggctgcagcaacaacaacttccagggctactacgtgtgcctgatcggcagcagcagcgagcccctgtacgtgcccaccctggacgactacagaagcgccgagatcctgagcagaatggccttcgccccccacggcgaggaccacgacatcgagagaaacgccatcagcgccatgagaatcgtgggcaaggtgaccggcaaggcccccagcagcgagagcagcgacaccgtgcagggcatcgccttcagcggcaaccccctgtacaccagcaccggcgtgctgaccagcaaggacgaccccgtgtacgtgtgggcccccggcatcatcatggagggcaaccacagcgtgtgcgacaagaagaccctgcccctgacctggaccggctacatccccctgcccggcgagatcgagaagaccacccagtgcaccgtgttctgcaccctggccggccccggcgccgactgcgaggcctacagcgagaccggcatcttcaacatcagcagccccacctgcctgatcaacagagtgcagagattcagaggcgccgagcagcagatcaagttcgtgtgccagagagtggacatggacatcaccgtgtactgcaacggcatcaagaaggtgatcctgaccaagaccctggtgatcggccagtgcatctacaccttcaccagcatcttcagcctgatgcccggcgtggcccacagcctggccgtggagctgtgcgtgcccggcctgcacggctgggccaccatgctgctgctgctgaccttctgcttcggctggatcctgatccccaccatcaccctgatcctgctgaagatcctgctggccttcgcctacgtgtgcagcaagtacaacaccgacagcaagttcaagatcctgatcgagaaggtgaagcaggagtaccagaagaccatgggcagcatggtgtgcgaggtgtgccagcacgagtgcgagaccgccaaggagctggagagccacaagaagagctgccccatcggcagctgcccctactgcctgaaccccgccgaggccaccaccagcgccctgcaggcccacttcaaggtgtgcaagctgaccagcagattccaggagaacctgagaaagagcctgaccgtgtacgagcccaagcagggctgctacagaaccctgagcctgttcagatacagaagcagatgcttcgtgggcctgatctggtgcatcctgctgaccctggagctggtggtgtgggccgccagcgccgagaccctgaacctgaaccccggctggaccgacaccgcccacggcagcggcatcgtgcccatgagaaccgacctggagctggacttcagcctgcccagcagcgccagctacacctacagaagaagcctgcagaaccccgccaacgagcaggagcagatccccttccacctgcagatcgagaagcaggtgatccacgccgagatccagcacctgggccactggatggacgccaccttcaacctgaagaccgccttccactgctacggcgcctgcgagaagtacgcctacccctggcagaccgccggctgcttcgtggagaaggacttcgagttcgagaacggctggggctgcaacccccccgactgccccggcgtgggcaccggctgcaccgcctgcggcgcctacctggacaagctgaagagcgtgggcaaggtgttcaagatcgtgagcctgagatacaccagaaaggcctgcatccagctgggcaccgagcagacctgcaagaacgtggacagcaacgactgcctggtgaccaccagcgtgaaggtgtgcctgatcggcaccatcagcaagttccagcccagcgacaccctgctgttcctgggccccctggagcagggcggcatcatcttcaagcagtggtgcaccaccacctgccagttcggcgaccccggcgacatcatgagcacccccatcggcatgaagtgccccgagctgaacggcagcttcagaaagaagtgcagcttcgccaccacccccgtgtgccagttcgacggcaacaccatcagcggctacaagagaatgatcgccaccaaggacagcttccagagcttcaacgtgaccgagccccacatcagcgccagcgccctggagtggatcgaccccgacagcagcctgagagaccacatcaacgtggtggtgggcagagacctgcccttccaggacctgagcgagaccccctgccagatcgacctgagcaccagcagcatcgacggcgcctggggcagcggcgtgggcttcaacctggtgtgcagcgtgagcctgaccgagtgcagcaccttcctgaccagcatcaaggcctgcgacaccgccatgtgctacggcagcaccaccgccaacctggtgagaggccagaacaccgtgcacgtggtgggcaagggcggccacagcggcagcaagttcgtgtgctgccacgacaccaagtgcagcaacaccggcctgctggccgccgccccccacctggacagagtgaccggctacaaccaggccgacagcgacaaggtgttcgacgacggcgcccccgagtgcggcatgacctgctggttcaagaagagcggcgagtggatcatgggcgtgctgagcggcaactggatggtggtggccgtgctgatcaccctgctggtgctgagcatcttcctgttcgccctgtgctgccccagaagagccgcctacaagaaggagcacaagccctga

SEQ ID NO: 8531 - RNA, 3408 nt, synthetic construct
  misc_feature 1..3408: note = derived and/or modified CDS sequence (opt4) from SANGV(SA14)__NC_034516.1__GP
  source 1..3408: mol_type = other RNA
atgatcatgtggggcctgctgctgctggccgccatcaccttcccctgccagagcctgaagaacgtgtacgacatgaagatcgagtgcccccacagcgtgaacttcggcgagagcagcgtgatgggcaaggtgcagctgcccagcctgagcatcaccgaggccgagcagctggtgcccgagagcagctgcaacatggacaaccaccagagcctgagcgtgctgcagaaggccaccaagaccacctggagaaagaaggccgaccacagcaacgccggcaaggacagctacgagctgatcaccagcgagatccagttcaagggcgtgtgcagcctgacccacaagatgatcgaggagagccacagactgagaagaagcgtgatctgctacgacctgagctgcaacaccacccactgcaagcccaccctgtacatggtggtgcccgtgcacagctgcaacatgatgaagagctgcctgatcggcctgggcccctacagaatccaggtggtgtacgagagaacctactgcaccgtgggcgtgctgaacgagggcaagtgcttcgtgcccgaccagagcgtggccaacatcgtgaagaacggcatcttcgacatcgtgagcgtgcagatcatctgcttcttcatcagaatcaagggcagcacctacaagatcctggagaccgtgaagaccgccatgaacggcaagtgcaacggcaccgacgacaaggtgcagggctactacatctgcctgctgggcggcaacagcggccccatctacgtgcccagcggcaccgacttcagagccatggaggccctggccaacatgctgagagccccccacggcgaggaccacgacctgcccggcgaggagctggccagctacagcatcgccggcaccatcgagggcaagatcccccacaccgccagcagccagaacctggagttcaccgcctacagcggcatccccagctacagcagcttcagcgtgcacaccctgacccaggacggccagctgagctacagccccggcctgttccccaacctgaaccagagcgactgcaagaagaacgccctgcccctgatctgggagggcaccatcgagctgcccggctactacgaggccatccacccctgcaacgtgttctgcgtgttcagcggccccggcgccagctgcgaggccttcagcgagggcggcatcttcaacatcaccagccccacctgcctggtgagcaagcagaacagattcagagccgccgagcagcagatcaccttcgtgtgccagagagtggacatggacatcatcatctactgcaacggccagagaaaggtgatcctgaccaagaccctggtgatcggccagtgcatctacagcatcaccagcctgttcagcctgctgcccagcgtggcccacagcatcgccatcgagctgtgcgtgcccggcttccacggctgggccaccgccgccctgctgaccaccttctgcttcggctggctgctgatccccagcatcacctacatcgtgctgctgatcctgaagttcatcgccgccatcttccacaacaccacccaggagaacaagttcaaggccatcctgagaaagatcaaggaggagttcgagaagaccaagggcagcatggtgtgcgacatctgcaagtacgagtgcgagaccggcaaggagctgaaggcccacaacctgagctgcaaccagagccagtgcccctactgcttcacccactgcgagatgaccgagagcgccttccaggcccactacaaggtgtgccaggccacccacagattcagagaggacctgaagaagaccatcaccccccagaccatcagccccggctgctacagaaccctgaacctgttcagatacaagagcagatgctacatcctgaccgtgtggctgtgcctgctgatcctggagagcatcgcctgggccgccagcgccagcgagaccagcctgaaccccctgtggaccgacaacgcccacggcgtgggcagcgtgcccatgcacaccgacctggagctggacttcagcctgcccagcagcagcaagtacacctacaagagaaagctgaccagccccaccaaccccgagcaggccgtgagcctgcacatcgagatcgagagccagggcatcgccgccgacgtgcacagcctgggccactggtacgacgccagactgaacctgaagaccagcttccactgctacggcgcctgcaccaagtaccagtacccctggcacaccgccaagtgccacttcgagcacgacttccagtacgagaacagctggggctgcaacccccccgactgccccggcgtgggcaccggctgcaccgcctgcggcctgtacctggaccagctgaagcccgtgggcagcgcctacaagctgatcaccgtgagatacagcagaaaggtgtgcgtgcagttcggcgaggagaacctgtgcaagaccatcgacatgaacgactgcttcatgagcagacacgtgaaggtgtgcatcatcggcaccgtgagcaagttcagccagggcgacaccctggtgttcctgggccccctggagggcggcggcctgatcttcaaggactggtgcaccagcacctgccagtacggcgaccccggcgacatcatgagccccagagacagaggcttcagctgccccgagttccccggcagcttcagaaagaagtgcaacttcgccaccacccccgtgtgcgagtacagcggcaacatggtgagcggctacaagaaggtgatggccaccatcgacagcttccagagcttcaacaccagcctgatccacttcaccgaggagagaatcgagtggaaggaccccgacggcatgctgagagaccacctgaacatcctggtgaccaaggacatcgacttcgagaacctgggcgagaacccctgcaaggtgggcctgcagaccagcagcatcgagggcgcctggggcagcggcgtgggcttcaccctggtgtgccaggtgagcctgatcgactgcgccagattcctgaccagcatcaaggcctgcgacatggccatctgctacggcgcccagagcgtgagcctggtgagaggccagaacaccgtgaagatcaccggcaagggcggccacagcggcagcagcttcaagtgctgccacgaggtggactgcagcagcaccggcctgcaggccagcgccccccacctggacaaggtgaacggcatcagcgagcaggagaacgacaaggtgtacgacgacggcgccccccagtgcggcgtgagctgctggttcgtgaagagcggcgagtggatcagcggcatcctgcacggcaactgggtggtggtggtggtgctggtgatcctgctgctgttcagcctgatcctgctgagcatcctgtgccccgtgagaaagcacaagagaagctga

SEQ ID NO: 8532 - RNA, 3408 nt, synthetic construct; identical to SEQ ID NO: 8531
  misc_feature 1..3408: note = derived and/or modified CDS sequence (opt4) from SANGV(SA14)__NC_034516.1__GP
  source 1..3408: mol_type = other RNA

SEQ ID NO: 8533 - RNA, 3402 nt, synthetic construct
  misc_feature 1..3402: note = derived and/or modified CDS sequence (opt4) from SEOV(L99)__AF288298.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtggtgtggagaaagaaggccaaccaggagctggccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccacaagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagagcctgaagctgatcgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgacccccaagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacgcctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcagctgccccgagttccccggccagttcagaaagaagtgcaacttcgccaccacccccatctgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagagcccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgagaatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8534 - RNA, 3402 nt, synthetic construct
  misc_feature 1..3402: note = derived and/or modified CDS sequence (opt4) from SEOV(Rn10-134)__JF693883.2__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgtggagatccccctggtgcccctgtggaccgacaacgcccacggcgtgggcagcgtgcccatgcacaccgacctggagctggacttcagcctgcccagcagcagcagatacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcctgaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8535 - RNA, 3402 nt, synthetic construct
  misc_feature 1..3402: note = derived and/or modified CDS sequence (opt4) from SEOV(Gou3-e5)__AF288650.1__GP
  source 1..3402: mol_type = other RNA
atgtggggcctgctgctgctggccgccctggtgggccagggcctggccctgaagaacgtgttcgacatgaagatccagtgcccccacagcgtgaacttcggcgagaccagcgtgagcggctacaccgagctgccccccctgcccctgcaggaggccgagcagctggtgcccgagagcagctgcaacatggacaaccaccagagcctgagcaccatcaacaagctgaccaaggtgatctggagaaagaaggccaaccaggagagcgccagccagaacagcttcgaggtggtggagaacgaggtgagcttcaagggcctgtgcatgctgaagcacagaatggtggaggagagctacagaaacagaagaagcgtgatctgctacgacctggcctgcaacaccaccttctgcaagcccaccgtgtacatgatcgtgcccatccacgcctgcaacatgatgaagagctgcctgatcggcctgggcccctacagaatccaggtgatctacgagagaacctactgcaccaccggcatcctgaccgagggcaagtgcttcgtgcccgacaaggccgtggtgagcgccctgaagagaggcatgtacgccatcgccagcatcgagaccatctgcttcttcgtgcaccagaagggcaacacctacaagatcgtgagcgccatcaccagcgccatgggcagcaagtgcaacaacaccgacagcaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccatccacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcgtggtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctggtgaccttctgcttcggctgggtgctgatccccgcctgcaccctggccgtgctgctgttcctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggatcctgctgctggtgatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccggctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacgtgatcagcggctacagaaaggtgctggccaccatcgacagcttccagagcttcaacaccagcaacgtgcacttcaccgacgagagaatcgagtggaaggaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccatcaagatcaccggcagaggcggccacagcggcagcagcttcaagtgctgccacggcaaggagtgcagcgccaacggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8536 - RNA, 3402 nt, synthetic construct
  misc_feature 1..3402: note = derived and/or modified CDS sequence (opt4) from SEOV(China)__EU163437.1__GP
  source 1..3402: mol_type = other RNA
atgtggagcctgctgctgctggccgccctggtgggccagggcttcgccctgaagaacgtgttcgacatgagaatccagtgcccccacagcgtgaagttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgagatcctggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatcatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacaagtacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagccagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcagaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactgctacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacagaagctacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcctgggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8537 - RNA, 3402 nt, synthetic construct
  misc_feature 1..3402: note = derived and/or modified CDS sequence (opt4) from SEOV(DPRK08)__JX853576.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccatctggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcatgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8538 - RNA, 3402 nt, synthetic construct
  misc_feature 1..3402: note = derived and/or modified CDS sequence (opt4) from SEOV(Fj372/2013)__KP645197.1__GP
  source 1..3402: mol_type = other RNA
atgtggagcctgctgctgctggccgccctggtgggccccggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggcagaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8539 - RNA, 3402 nt, synthetic construct
  misc_feature 1..3402: note = derived and/or modified CDS sequence (opt4) from SEOV(HeB38)__JN377554.1__GP
  source 1..3402: mol_type = other RNA
atgtggagcctgctgctgctggccgccctggtgggccagggcttcgccctgaagaacgtgttcgacatgagaatccagtgcccccacagcgtgaagttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggcagaagaaggccaaccaggagagcgccaaccagaacagcttcgaggtggccgagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccagcggcgaggacttcagagccatggaggtgttcagcggcatcatcatgagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgctgagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8540 - RNA, 3402 nt, synthetic construct
  misc_feature 1..3402: note = derived and/or modified CDS sequence (opt4) from SEOV(JiangxiXinjianRn-07-2011)__KP859513.1__GP
  source 1..3402: mol_type = other RNA
atgtggagcctgctgctgctggccgccctggtgggccagtgcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacttctgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8541 - RNA, 3402 nt, synthetic construct
  misc_feature 1..3402: note = derived and/or modified CDS sequence (opt4) from SEOV(LYON/Rn/FRA/2013/LYO852)__KF387724.1__GP
  source 1..3402: mol_type = other RNA
atgtggagcctgctgctgctggccgccctggccggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccagccagaacagcttcgaggtggtggagagcgaggtgagcttcaagggcctgtgcatgctgagacacagaatggtggaggagagctacaagaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcatcatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcctgaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgttcctgctgttcagcctgatcctgctgagcatcctgtgccccgtgagaaagcacaagaagagctga

SEQ ID NO: 8542 - RNA, 3402 nt, synthetic construct
  misc_feature 1..3402: note = derived and/or modified CDS sequence (opt4) from SEOV(Seoul-Baxter/NYC-D1_M)__KJ950863.1__GP
  source 1..3402: mol_type = other RNA
atgtggagcctgctgctgctggccgccctggtgggccagggcttcgccctgaagaacgtgttcgacatgaagatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggccgagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacgacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctggtgtggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcctgcagttcggcgaggagtacctgtgcaagaccatcgacatgaacgactgcttcgtgaccagacacgtgaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8543 - RNA, 3402 nt, synthetic construct
  misc_feature 1..3402: note = derived and/or modified CDS sequence (opt4) from SEOV(Singapore/06(RN41))__GQ274942.1__GP
  source 1..3402: mol_type = other RNA
atgtggagcctgctgctgctggccgccctggccggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccagccagaacagcttcgaggtggtggagagcgagatcagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8544 - RNA, 3402 nt, synthetic construct
  misc_feature 1..3402: note = derived and/or modified CDS sequence (opt4) from SEOV(11CSG)__AB618131.1__GP
  source 1..3402: mol_type = other RNA
atgtggagcctgctgctgctggccgccctggccggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccagccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcgtgcaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagttcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacaccatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactggatcgtgctgatcgtgctgtgcgtgctgctgctgttcagcctgatcctgctgagcatcctgtgccccgtgagaaagcacaagaagagctga

SEQ ID NO: 8545 - RNA, 3402 nt, synthetic construct
  misc_feature 1..3402: note = derived and/or modified CDS sequence (opt4) from SEOV(5CSG)__AB618130.1__GP
  source 1..3402: mol_type = other RNA
atgtggagcctgctgctgctggccgccctggccggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccagccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccatccacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcgtgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacaccatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8546 - RNA, 3402 nt, synthetic construct
  misc_feature 1..3402: note = derived and/or modified CDS sequence (opt4) from SEOV(80-39)__S47716.1__GP
  source 1..3402: mol_type = other RNA
atgtggagcctgctgctgctggccgccctggtgggccagggcttcgccctgaagaacgtgttcgacatgagaatccagtgcccccacagcgtgaagttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgagctgatggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagagtgcaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctgaccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcagatacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcagagcctgcgacatggccatctgctacggcgccgagagcgtgaccctgagcagaggccagaacaccgtgaagatcaccggcaagggcggccacagcggcagcagcttcaagtgctgccacggcaaggagtgcagcctgaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8547 - RNA, 3402 nt, synthetic construct
  misc_feature 1..3402: note = derived and/or modified CDS sequence (opt4) from SEOV(93HBQ3)__KM115585.1__GP
  source 1..3402: mol_type = other RNA
atgtggagcctgctgctgctggccgccctggtgggccagggcttcgccctgaagaacgtgttcgacatgagaatccagtgcccccacagcgtgaagttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggcagaagaaggccaaccaggagagcgccaaccagaacagcttcgaggtggccgagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccagcggcgaggacttcagagccatggaggtgttcagcggcatcatcatgagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccctgaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgctgagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8548 - RNA, 3402 nt, synthetic construct
  misc_feature 1..3402: note = derived and/or modified CDS sequence (opt4) from SEOV(93HBQ4)__KM115586.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggccgagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccagcggcgaggacttcagagccatggaggtgttcagcggcatcatcatgagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcggcgacagcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagaccatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagagagtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8549 - RNA, 3402 nt, synthetic construct
  misc_feature 1..3402: note = derived and/or modified CDS sequence (opt4) from SEOV(B1)__AB457790.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgagactgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctggatcctgatccccgcctggaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaagatctgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaagctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcctgctgctgctgttcagcctgatcctgctgagcatcctgtgccccgtgagaaagcacaagaagagctga

SEQ ID NO: 8550 - RNA, 3402 nt, synthetic construct
  misc_feature 1..3402: note = derived and/or modified CDS sequence (opt4) from SEOV(B1)__AB457791.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggcagaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggcctacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgagactgaccgccttcgccggcatccccagctacagcagcaccagcatcctggccgccagcaaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctggatcctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaagatctgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcctgctgctgctgttcagcctgatcctgctgagcatcctgtgccccatcagaaagcacaagaagagctga

SEQ ID NO: 8551 - RNA, 3402 nt, synthetic construct
  misc_feature 1..3402: note = derived and/or modified CDS sequence (opt4) from SEOV(B1)__AB457792.1__GP
  source 1..3402: mol_type = other RNA
atgtggagcctgctgctgatggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggcagaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggcctacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgagactgaccgccttcgccggcatccccagctacagcagcaccagcatcctggccgccagcaaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctggatcctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaagatctgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcctgctgctgctgttcagcctgatcctgctgagcatcctgtgccccatcagaaagcacaagaagagctga

SEQ ID NO: 8552 - RNA, 3402 nt, synthetic construct
  misc_feature 1..3402: note = derived and/or modified CDS sequence (opt4) from SEOV(B1)__AB457793.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggcagaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggcctacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgagactgaccgccttcgccggcatccccagctacagcagcaccagcatcctggccgccagcaaggacggccacttcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctggatcctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaagatctgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcctgctgctgctgttcagcctgatcctgctgagcatcctgtgccccatcagaaagcacaagaagagctga

SEQ ID NO: 8553 - RNA, 3402 nt, synthetic construct
  misc_feature 1..3402: note = derived and/or modified CDS sequence (opt4) from SEOV(B1)__AB457794.1__GP
  source 1..3402: mol_type = other RNA
atgtggagcctgctgctgatggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggcagaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggcctacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgagactgaccgccttcgccggcatccccagctacagcagcaccagcatcctggccgccagcaaggacggccacttcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctggatcctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaagatctgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcctgctgctgctgttcagcctgatcctgctgagcatcctgtgccccatcagaaagcacaagaagagctga

SEQ ID NO: 8554 - RNA, 3402 nt, synthetic construct
  misc_feature 1..3402: note = derived and/or modified CDS sequence (opt4) from SEOV(B-1)__X53861.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctactacgacctggccggcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagtggaacaagtacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccacatcagcggccagatcgaggccaagatcccccacaccgtgagcagcaagaacctgagactggccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagagaaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagcacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccagagacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8555 - RNA, 3402 nt, synthetic construct
  misc_feature 1..3402: note = derived and/or modified CDS sequence (opt4) from SEOV(BjHD01)__DQ133505.1__GP
  source 1..3402: mol_type = other RNA
atgtggagcctgctgttcctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggaggtggccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcgaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8556 - RNA, 3402 nt, synthetic construct
  misc_feature 1..3402: note = derived and/or modified CDS sequence (opt4) from SEOV(Cherwell)__KM948593.1__GP
  source 1..3402: mol_type = other RNA
atgtggagcctgctgctgctggccgccctggtgggccagggcagcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccccaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcgtgtacctggaccagctgaagcccgtgggcaccgccttcaagatcgtgagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcagcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8557 - RNA, 3402 nt, synthetic construct
  misc_feature 1..3402: note = derived and/or modified CDS sequence (opt4) from SEOV(HaixingRn40)__GU592924.1__GP
  source 1..3402: mol_type = other RNA
atgtggagcctgctgttcctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccagaaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctgggccagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgacctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8558 - RNA, 3402 nt, synthetic construct
  misc_feature 1..3402: note = derived and/or modified CDS sequence (opt4) from SEOV(HBQ17)__KM233655.1__GP
  source 1..3402: mol_type = other RNA
atgtggagcctgctgttcgtggccgccctgatcggccagggcttcgccctggagaacgccttcgacatgagaatcagatgcccccacagcgtgcacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgccctgaagatcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8559 - RNA, 3402 nt, synthetic construct
  misc_feature 1..3402: note = derived and/or modified CDS sequence (opt4) from SEOV(HBQ20)__KM233656.1__GP
  source 1..3402: mol_type = other RNA
atgtggagcctgctgttcctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgtgatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacaccgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8560 - RNA, 3402 nt, synthetic construct
  misc_feature 1..3402: note = derived and/or modified CDS sequence (opt4) from SEOV(HBQ43)__KM233657.1__GP
  source 1..3402: mol_type = other RNA
atgtggagcctgctgttcctggccgccctggtgggccagggcgtggccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcttcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcatcctgctgctgttcagcctgatcctgctgagcatcctgtgccccgtgagaaagcacaagaagagctga

SEQ ID NO: 8561 - RNA, 3402 nt, synthetic construct
  misc_feature 1..3402: note = derived and/or modified CDS sequence (opt4) from SEOV(HBQ5)__KM233653.1__GP
  source 1..3402: mol_type = other RNA
atgtggagcctgctgttcctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8562 - RNA, 3402 nt, synthetic construct
  misc_feature 1..3402: note = derived and/or modified CDS sequence (opt4) from SEOV(HBT14)__KM233658.1__GP
  source 1..3402: mol_type = other RNA
atgtggagcctgctgttcctggccgccctggtgggccagggcttcgccctgaagaacgtgttcgacatgagaatccagtgcccccacagcgtgaacttcggcgagaccagcgtgagcggctacaccggcctgccccccctgagcctgcaggaggccgagcagctggtgcccgagagcagctgcaacatggacaaccaccagagcctgagcatcatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8563 - RNA, 3402 nt, synthetic construct
  misc_feature 1..3402: note = derived and/or modified CDS sequence (opt4) from SEOV(HBT-3)__KM233661.1__GP
  source 1..3402: mol_type = other RNA
atgtggagcctgctgttcctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctgccctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccttcaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8564 - RNA, 3402 nt, synthetic construct
  misc_feature 1..3402: note = derived and/or modified CDS sequence (opt4) from SEOV(HBT49)__KM233659.1__GP
  source 1..3402: mol_type = other RNA
atgtggagcctgctgttcctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgtaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8565 - RNA, 3402 nt, synthetic construct
  misc_feature 1..3402: note = derived and/or modified CDS sequence (opt4) from SEOV(HBT50)__KM233660.1__GP
  source 1..3402: mol_type = other RNA
atgtggagcctgctgttcctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcagacactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8566 - RNA, 3402 nt, synthetic construct
  misc_feature 1..3402: note = derived and/or modified CDS sequence (opt4) from SEOV(HuludaoRn101)__GU592923.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtggtgtggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgatcgccttcgccggcatccccagctacagcagcaccagcatcctggccgccagcgaggacagcagattcatcttcagccccggcctgttccccaacctgaaccagagcgtgtgcgacaacaacgccctgcccctgatctggagaggcctgatcgacctgaccggctactacgagaccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcatccccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccatctgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacgtggtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgagaatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8567 - RNA, 3402 nt, synthetic construct
  misc_feature 1..3402: note = derived and/or modified CDS sequence (opt4) from SEOV(Humber)__JX879768.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcgtgcaccagaagggcaacacctacaagatcgtgaccgccatcaccagcgccatgggcagcaagtgcaacaacaccgacaccaaggtgcagggctactacatctgcatcatcggcggcaacagcgcccccgtgtacagccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccgtgctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcatccagggcgagtgcccctactgcttcacccactgcgagcccaccgagaccgccatccaggcccactacaaggtgtgccaggccacccacagattcagagaggacctgaagaagaccgtgaccccccccaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcatcatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaacggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8568 - RNA, 3402 nt, synthetic construct
  misc_feature 1..3402: note = derived and/or modified CDS sequence (opt4) from SEOV(Humber)__KM948597.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcgtgcaccagaagggcaacacctacaagatcgtgaccgccatcaccagcgccatgggcagcaagtgcaacaacaccgacaccaaggtgcagggctactacatctgcatcatcggcggcaacagcgcccccgtgtacagccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccgtgctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcatccagggcgagtgcccctactgcttcacccactgcgagcccaccgagaccgccatccaggcccactacaaggtgtgccaggccacccacagattcagagaggacctgaagaagaccgtgaccccccccaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcatcatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgctgagaggccagaacaccgtgaagatcaccggcaagggcggccacagcggcagcagcttcaagtgctgccacggcaaggagtgcagcagcaacggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8569 - RNA, 3402 nt, synthetic construct
  misc_feature 1..3402: note = derived and/or modified CDS sequence (opt4) from SEOV(K24-e7)__AF288652.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtggtgtggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccggcaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgatcgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttcagagtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcatgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccatctgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgagaatcaccggcagaggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8570 - RNA, 3402 nt, synthetic construct
  misc_feature 1..3402: note = derived and/or modified CDS sequence (opt4) from SEOV(K24-v2)__AF288654.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtggtgtggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaccgccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgacgaccacgacctgcccggcgaggagatcgccccctaccagatcagcggccagatcgaggccaagatcccccacaccgtgagcagcaagaacctgaagctgatcgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacgaccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacggcgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcatgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccatctgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgagaatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8571 - RNA, 3402 nt, synthetic construct
  misc_feature 1..3402: note = derived and/or modified CDS sequence (opt4) from SEOV(KI-83-262)__D17592.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgagcctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8572 - RNA, 3402 nt, synthetic construct
  misc_feature 1..3402: note = derived and/or modified CDS sequence (opt4) from SEOV(KI-85-1)__D17593.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcgccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcttcatcctgctgagcatcctgtgccccgtgagaaagcacaagaagagctga

SEQ ID NO: 8573 - RNA, 3402 nt, synthetic construct
  misc_feature 1..3402: note = derived and/or modified CDS sequence (opt4) from SEOV(KI-88-15)__D17594.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgagatcgtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctgaagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcttcatcctgctgagcatcctgtgccccgtgagaaagcacaagaagagctga

SEQ ID NO: 8574 - RNA, 3402 nt, synthetic construct
  misc_feature 1..3402: note = derived and/or modified CDS sequence (opt4) from SEOV(LongwanRn581)__GU592930.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccaacgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8575 - RNA, 3402 nt, synthetic construct
  misc_feature 1..3402: note = derived and/or modified CDS sequence (opt4) from SEOV(RuianRn180)__GU592931.1__GP
  source 1..3402: mol_type = other RNA
atgtggagcctgctgatcgtggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8576 - RNA, 3402 nt, synthetic construct
  misc_feature 1..3402: note = derived and/or modified CDS sequence (opt4) from SEOV(ShuangyangRn470)__GU592925.1__GP
  source 1..3402: mol_type = other RNA
atgtggagcctgctgttcctggccgccctggtgggccagggcttcgccctgaagaacgtgttcgacatgagaatccagtgcccccacagcgtgaacttcggcgagaccagcgtgagcggctacaccgagctgccccccctgagcctgcaggagagcgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcaacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcgtggagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagacctgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8577 - RNA, 3402 nt, synthetic construct
  misc_feature 1..3402: note = derived and/or modified CDS sequence (opt4) from SEOV(WuhanMm13)__JQ665886.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtgatcgagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccgtggccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgaccaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccatcctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgccctgtgcgtgctgctgctgttcagcctgatcctgctgagcatcctgtgccccgtgagaaagcacaagaagagctga

SEQ ID NO: 8578 - RNA, 3402 nt, synthetic construct
  misc_feature 1..3402: note = derived and/or modified CDS sequence (opt4) from SEOV(WuhanMm24)__JQ665887.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtgatggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcagatacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccagccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcctgaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgccctgtgcgtgctgctgctgttcagcctgatcctgctgagcatcctgtgccccgtgagaaagcacaagaagagctga

SEQ ID NO: 8579 - RNA, 3402 nt, synthetic construct
  misc_feature 1..3402: note = derived and/or modified CDS sequence (opt4) from SEOV(WuhanRf02)__JQ665888.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtgatcgagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccgtggccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagagaatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgaccaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcgtggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaacagcagacccgacggcctgaccatgtggaccctgctgctgatcatcgagagcatcctgtgggccgccagcgccgccgagatccccctggtgcccctgtgggccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgcccaagttcagccagggcgacaccctgctgttcctgggccccatggagggcggcggcatcatcttcaagcactggtgcaccagcacctgccacttcggcgaccccggcgacgtgatgggccccaaggacaagcccttcatcagacccgagttccccggccagttcagaaagaagtgcaacttcgccaccacccccgtgtgcggctacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgccctgtgcgtgctgctgctgttcagcctgatcctgctgagcatcctgtgccccgtgagaaagcacaagaagagctga

SEQ ID NO: 8580 - RNA, 3402 nt, synthetic construct
  misc_feature 1..3402: note = derived and/or modified CDS sequence (opt4) from SEOV(WuhanRf07)__JQ665889.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtgatcgagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccgtggccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgaccaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagaccctacatcctgaccatgtggaccatcctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgccctgtgcgtgctgctgctgttcagcctgatcctgctgagcatcctgtgccccgtgagaaagcacaagaagagctga

SEQ ID NO: 8581 - RNA, 3402 nt, synthetic construct
  misc_feature 1..3402: note = derived and/or modified CDS sequence (opt4) from SEOV(WuhanRf18)__JQ665893.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtgatcgagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccgtggccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagagaatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgaccaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccatcctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgccctgtgcgtgctgctgctgttcagcctgatcctgctgagcatcctgtgccccgtgagaaagcacaagaagagctga

SEQ ID NO: 8582 - RNA, 3402 nt, synthetic construct
  misc_feature 1..3402: note = derived and/or modified CDS sequence (opt4) from SEOV(WuhanRn10)__JQ665896.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtgatcgagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccgtggccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgaccaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaacaagggcagcgtggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccatcctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgccctgtgcgtgctgctgctgttcagcctgatcctgctgagcatcctgtgccccgtgagaaagcacaagaagagctga

SEQ ID NO: 8583 - RNA, 3402 nt, synthetic construct
  misc_feature 1..3402: note = derived and/or modified CDS sequence (opt4) from SEOV(WuhanRn25)__JQ665897.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtgatcgagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccgtggccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgaccaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaacaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccatcctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgccctgtgcgtgctgctgctgttcagcctgatcctgctgagcatcctgtgccccgtgagaaagcacaagaagagctga

SEQ ID NO: 8584 - RNA, 3402 nt, synthetic construct
  misc_feature 1..3402: note = derived and/or modified CDS sequence (opt4) from SEOV(XiaotangshanRn7)__GU592929.1__GP
  source 1..3402: mol_type = other RNA
atgtggagcctgctgttcctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaagaaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8585 - RNA, 3402 nt, synthetic construct
  misc_feature 1..3402: note = derived and/or modified CDS sequence (opt4) from SEOV(YongjiaRf45)__GU592926.1__GP
  source 1..3402: mol_type = other RNA
atgtggggcctgctgctgctggccgccatggtgggccagggcagcgccctgaagaacgtgttcgacatgaagatccagtgcccccacagcgtgaacttcggcgagaccagcgtgagcggctacaccgagctgccccccctgcccctgcaggaggccgagcagctggtgcccgagagcagctgcaacatggacaaccaccagagcctgagcaccatcaacaagctgaccaaggtgatctggagaaagaaggccaaccaggagagcgccagccagaacagcttcgaggtggtggagagcgaggtgagcttcaagggcctgtgcatgctgaagcacagaatggtggaggagagctacagaaacagaagaagcgtgatctgctacgacctggcctgcaacaccaccttctgcaagcccaccgtgtacatgatcgtgcccatccacgcctgcaacatgatgaagagctgcctgatcggcctgggcccctacagaatccaggtgatctacgagagaacctactgcagcaccggcatcctgaccgagggcaagtgcttcgtgcacgacaagaccgtggtgagcgccctgaagagaggcatgtacgccatcgccagcatcgagaccgtgtgcttcttcgtgcaccagaagggcaacacctacaagatcgtgaccgccatcaccagcgccatgggcagcaagtgcaacaacaccgacagcaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggaggtggccacctaccagatcagcggccagatcgaggccaagatcccccacaccgtgagcagcaagaacctgaagctgaccgccttcgccggcatccccagctacagcagcaccagcctgctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccgtgctgctgttcctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggatcctgctgctggtgatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgctacttcgagaaggactacgagtacgagaacagctgggcctgcaacccccccgactgccccggcgtgggcatcggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacgtgttcagcggctacagaaagttcctggccaccatcgacagcttccagagcttcaacaccagcaacgtgcacttcaccgacgagagaatcgagtggagagaccccgacggcatgctgagagaccacatcaacatcgtgatcagcaaggacatcgacttcgagaacctggccgacaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaacggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactggatcgtgctgatcgtgctgtgcgtgctgctgctgttcagcctgatcctgctgagcatcctgtgccccgtgagaaagcacaagaagagctga

SEQ ID NO: 8586 - RNA, 3402 nt, synthetic construct
  misc_feature 1..3402: note = derived and/or modified CDS sequence (opt4) from SEOV(YongjiaRn14)__GU592927.1__GP
  source 1..3402: mol_type = other RNA
atgtggggcctgctgctgctggccgccatggtgggccagggcagcgccctgaagaacgtgttcgacatgaagatccagtgcccccacagcgtgaacttcggcgagaccagcgtgagcggctacaccgagctgccccccctgcccctgcaggaggccgagcagctggtgcccgagagcagctgcaacatggacaaccaccagagcctgagcaccatcaacaagctgaccaaggtgatctggagaaagaaggccaaccaggagagcgccagccagaacagcttcgaggtggtggagagcgaggtgagcttcaagggcctgtgcatgctgaagcacagaatggtggaggagagctacagaaacagaagaagcgtgatctgctacgacctggcctgcaacaccaccttctgcaagcccaccgtgtacatgatcgtgcccatccacgcctgcaacatgatgaagagctgcctgatcggcctgggcccctacagaatccaggtgatctacgagagaacctactgcaccaccggcatcctgaccgagggcaagtgcttcgtgcccgacaaggccgtggtgagcgccctgaagagaggcatgtacgccatcgccagcatcgagaccgtgtgcttcttcgtgcaccagaagggcaacacctacaagatcgtgaccgccatcaccagcgccatgggcagcaagtgcaacaacaccgacagcaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggaggtggccacctaccagatcagcggccagatcgaggccaagatcccccacaccgtgagcagcaagaacctgaagctgaccgccttcgccggcatccccagctacagcagcaccagcctgctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccgtgctgctgttcctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggatcctgctgctggtgatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacgtgatcagcggctacagaaaggtgctggccaccatcgacagcttccagagcttcaacaccagcaacgtgcacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaacggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactggatcgtgctgatcgtgctgtgcgtgctgctgctgttcagcctgatcctgctgagcatcctgtgccccgtgagaaagcacaagaagagctga

SEQ ID NO: 8587 - RNA, 3402 nt, synthetic construct
  misc_feature 1..3402: note = derived and/or modified CDS sequence (opt4) from SEOV(ZT10)__DQ159911.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacaagtacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagatcagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactgctacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcctgggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8588 - RNA, 3402 nt, synthetic construct
  misc_feature 1..3402: note = derived and/or modified CDS sequence (opt4) from SEOV(ZT71)__EF117248.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctggccgagggcaagtgcttcgtgcccgacaaggccgtggtgagcgccctgaagagaggcatgtacgccatcgccagcatcgagaccatctgcttcttcatccaccagaagggcaacaagtacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccggcctgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaccctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8589 - RNA, 3402 nt, synthetic construct
  misc_feature 1..3402: note = derived and/or modified CDS sequence (opt4) from SEOV(DN2)__KX289953.1__GP
  source 1..3402: mol_type = other RNA
atgtggagcctgctgctgctggccgccctggccggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccagccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagaatcgacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctgatccccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgagacccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacaccatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8590 - RNA, 3402 nt, synthetic construct
  misc_feature 1..3402: note = derived and/or modified CDS sequence (opt4) from SEOV(IR162)__KX079475.1__GP
  source 1..3402: mol_type = other RNA
atgtggagcctgctgctgctggccgccctggtgggcagaggcttcaccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcgtgctgatcgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccaccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcatcggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgacctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8591 - RNA, 3402 nt, synthetic construct
  misc_feature 1..3402: note = derived and/or modified CDS sequence (opt4) from SEOV(Gou3)__AF145977.2__GP
  source 1..3402: mol_type = other RNA
atgtggggcctgctgctgctggccgccctggtgggccagggcctggccctgaagaacgtgttcgacatgaagatccagtgcccccacagcgtgaacttcggcgagaccagcgtgagcggctacaccgagctgccccccctgcccctgcaggaggccgagcagctggtgcccgagagcagctgcaacatggacaaccaccagagcctgagcaccatcaacaagctgaccaaggtgatctggagaaagaaggccaaccaggagagcgccagccagaacagcttcgaggtggtggagaacgaggtgagcttcaagggcctgtgcatgctgaagcacagaatggtggaggagagctacagaaacagaagaagcgtgatctgctacgacctggcctgcaacaccaccttctgcaagcccaccgtgtacatgatcgtgcccatccacgcctgcaacatgatgaagagctgcctgatcggcctgggcccctacagaatccaggtgatctacgagagaacctactgcaccaccggcatcctgaccgagggcaagtgcttcgtgcccgacaaggccgtggtgagcgccctgaagagaggcatgtacgccatcgccagcatcgagaccatctgcttcttcgtgcacaagaagggcaacacctacaagatcgtgagcgccatcaccctggccatgggcagcaagtgcaacaacaccgacagcaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccatccacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcgtggtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctggtgaccttctgcttcggctgggtgctgatccccgcctgcaccctggccgtgctgctgttcctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggatcctgctgctggtgatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcgccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacgtgatcagcggctacagaaaggtgctggccaccatcgacagcttccagagcttcaacaccagcaacgtgcacttcaccgacgagagaatcgagtggaaggaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcgaggcctgcgacatggccatctgctacggcgccgagagcgtgaccctgagcagaggccagaacaccatcaagatcaccggcaagggcggccacagcggcagcagcttcaagtgctgccacggcaaggagtgcagcgccaacggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8592 - RNA, 3402 nt, synthetic construct
  misc_feature 1..3402: note = derived and/or modified CDS sequence (opt4) from SEOV(HB55)__AF035832.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtggtgtggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgggcgccctgaagagaggcatgtacgccatcgccagcatcgagaccatctgcttcttcatccaccagaagggcaacaagtacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgatcgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggcctgcgtgcagttcggcgaggagtacctgtgcaagaccatcgacatgaacgactgcttcgtgaccggccacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccatctgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgagaatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8593 - RNA, 3402 nt, synthetic construct
  misc_feature 1..3402: note = derived and/or modified CDS sequence (opt4) from SEOV(L99)__AF035833.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtggtgtggagaaagaaggccaaccaggagctggccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgatcgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgacccccaagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcagctgccccgagttccccggccagttcagaaagaagtgcaacttcgccaccacccccatctgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgagaatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcgtgacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8594 - RNA, 3402 nt, synthetic construct
  misc_feature 1..3402: note = derived and/or modified CDS sequence (opt4) from SEOV(Z37)__AF187081.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacaagtacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagatcagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgccaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcaccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8595 - RNA, 3402 nt, synthetic construct
  misc_feature 1..3402: note = derived and/or modified CDS sequence (opt4) from SEOV(Z37)__AF190119.1__GP
  source 1..3402: mol_type = other RNA
atgtggagcctgctgctgctggccgccctggtgggccagggcttcgccctgaagaacgtgttcgacatgagaatccagtgcccccacagcgtgaacttcggcgagaccagcgtgagcggctacaccgagctgccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcatctgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgacgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagtacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttcgccggccagttcagaaagaagtgcaacttcgccaccacccccgtgtgcgagtacgacggcaacatcatcagcggctacaagaaggtgctggagaccatcgacagcttccagagcttcaacaccagcaacatccacttcaccgacgagagaatcgagtggagagaccccgacggcatgctgagagaccacatcaacatcgtgatcagcaaggacatcgacttcgagaacatggccgagaacccctgcaaggtgggcctgcaggccgccaacatcgagggcgcctggggcagcggcgtgggcttcaccctgacctgccaggtgagcctgaccgagtgccccaccagcctgaccagcatcaaggcctgcgacatggccatctgctacggcgccgagagcgtgaccctgagcagaggccagaacaccgtgaagatcaccggcaagggcggccacagcggcagcagcttcaagagatgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8596 - RNA, 3402 nt, synthetic construct
  misc_feature 1..3402: note = derived and/or modified CDS sequence (opt4) from SEOV__M34882.1__GP
  source 1..3402: mol_type = other RNA
atgtggagcctgctgctgctggccgccctggtgggccagggcttcgccctgaagaacgtgttcgacatgagaatccagctgccccacagcgtgaacttcggcgagaccagcgtgagcggctacaccgagttcccccccctgagcctgcaggaggccgagcagctggtgcccgagagcagctgcaacatggacaaccaccagagcctgagcaccatcaacaagctgaccaaggtgatctggagaaagaaggccaaccaggagagcgccaaccagaacagcttcgaggtggtggagagcgaggtgagcttcaagggcctgtgcatgctgaagcacagaatggtggaggagagctacagaaacagaagaagcgtgatctgctacgacctggcctgcaacagcaccttctgcaagcccaccgtgtacatgatcgtgcccatccacgcctgcaacatgatgaagagctgcctgatcggcctgggcccctacagaatccaggtggtgtacgagagaacctactgcaccaccggcatcctgaccgagggcaagtgcttcgtgcccgacaaggccgtggtgagcgccctgaagagaggcatgtacgccatcgccagcatcgagaccatctgcttcttcatccaccagaagggcaacacctacaagatcgtgaccgccatcaccagcgccatgggcagcaagtgcaacaacaccgacaccaaggtgcagggctactacatctgcatcatcggcggcaacagcgcccccgtgtacgcccccgccggcgaggacttcagagccatggaggtgttcagcggcatcatcaccagcccccacggcgaggaccacgacctgcccggcgaggagatcgccacctaccagatcagcggccagatcgaggccaagatcccccacaccgtgagcagcaagaacctgaagctgaccgccttcgccggcatccccagctacagcagcaccagcatcctggccgccagcgaggacggcagattcatcttcagccccggcctgttccccaacctgaaccagagcgtgtgcgacaacaacgccctgcccctgatctggagaggcctgatcgacctgaccggctactacgaggccgtgcacccctgcaacgtgttctgcgtgctgagcggccccggcgccagctgcgaggccttcagcgagggcggcatcttcaacatcaccagccccatgtgcctggtgagcaagcagaacagattcagagccgccgagcagcagatcagcttcgtgtgccagagagtggacatggacatcatcgtgtactgcaacggccagaagaagaccatcctgaccaagaccctggtgatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctgggtgctgatccccgcctgcaccctggccatcctgctggtgctgaagttcttcgccaacatcctgcacaccagcaaccaggagaacagattcaaggccatcctgagaaagatcaaggaggagttcgagaagaccaagggcagcatggtgtgcgagatctgcaagtacgagtgcgagaccctgaaggagctgaaggcccacaacctgagctgcgtgcagggcgagtgcccctactgcttcacccactgcgagcccaccgagaccgccatccaggcccactacaaggtgtgccaggccacccacagattcagagaggacctgaagaagaccgtgaccccccagaacatcggccccggctgctacagaaccctgaacctgttcagatacaagagcagatgctacatcctgaccatgtggaccctgctgctgatcatcgagagcatcctgtgggccgccagcgccgccgagatccccctggtgcccctgtggaccgacaacgcccacggcgtgggcagcgtgcccatgcacaccgacctggagctggacttcagcctgcccagcagcagcaagtacacctacaagagacacctgaccaaccccgtgaacgaccagcagagcgtgagcctgcacatcgagatcgagagccagggcatcggcgccgccgtgcaccacctgggccactggtacgacgccagactgaacctgaagaccagcttccactgctacggcgcctgcaccaagtaccagtacccctggcacaccgccaagtgccacttcgagaaggactacgagtacgagaacagctgggcctgcaacccccccgactgccccggcgtgggcaccggctgcaccgcctgcggcctgtacctggaccagctgaagcccgtgggcaccgccttcaagatcatcagcgtgagatacagcagaaaggtgtgcgtgcagttcggcgaggagcacctgtgcaagaccatcgacatgaacgactgcttcgtgaccagacacgccaagatctgcatcatcggcaccgtgagcaagttcagccagggcgacaccctgctgttcctgggccccatggagggcggcggcatcatcttcaagcactggtgcaccagcacctgccacttcggcgaccccggcgacgtgatgggccccaaggacaagcccttcatctgccccgagttccccggccagttcagaaagaagtgcaacttcgccaccacccccgtgtgcgagtacgacggcaacatcatcagcggctacaagaaggtgctggccaccatcgacagcttccagagcttcaacaccagcaacatccacttcaccgacgagagaatcgagtggagagaccccgacggcatgctgagagaccacatcaacatcgtgatcagcaaggacatcgacttcgagaacctggccgagaacccctgcaaggtgggcctgcaggccgccaacatcgagggcgcctggggcagcggcgtgggcttcaccctgacctgcaaggtgagcctgaccgagtgccccaccttcctgaccagcatcaaggcctgcgacatggccatctgctacggcgccgagagcgtgaccctgagcagaggccagaacaccgtgaagatcaccggcaagggcggccacagcggcagcagcttcaagtgctgccacggcaaggagtgcagcagcaccggcctgcaggccagcgccccccacctggacaaggtgaacggcatcagcgagctggagaacgagaaggtgtacgacgacggcgcccccgagtgcggcatcacctgctggttcaagaagagcggcgagtgggtgatgggcatcatcaacggcaactgggtggtgctgatcgtgctgtgcgtgctgctgctgttcagcctgatcctgctgagcatcctgtgccccgtgagaaagcacaagaagagctga

SEQ ID NO: 8597 - RNA, 3423 nt, synthetic construct
  misc_feature 1..3423: note = derived and/or modified CDS sequence (opt4) from SNV(NM H10)__NC_005215.1__GP
  source 1..3423: mol_type = other RNA
atggtgggctgggtgtgcatcttcctggtggtgctgaccaccgccaccgccggcctgaccagaaacctgtacgagctgaagatcgagtgcccccacaccgtgggcctgggccagggctacgtgaccggcagcgtggagatcacccccatcctgctgacccaggtggccgacctgaagatcgagagcagctgcaacttcgacctgcacgtgcccgccaccaccacccagaagtacaaccaggtggactggaccaagaagagcagcaccaccgagagcaccaacgccggcgccaccaccttcgaggccaagaccaaggagatcaacctgaagggcacctgcaacatcccccccaccaccttcgaggccgcctacaagagcagaaagaccgtgatctgctacgacctggcctgcaaccagacccactgcctgcccaccgtgcacctgatcgcccccgtgcagacctgcatgagcgtgagaagctgcatgatcggcctgctgagcagcagaatccaggtgatctacgagaagacctactgcgtgaccggccagctgatcgagggcctgtgcttcatccccacccacaccatcgccctgacccagcccggccacacctacgacaccatgaccctgcccgtgacctgcttcctggtggccaagaagctgggcacccagctgaagctggccgtggagctggagaagctgatcaccggcgtgagctgcaccgagaacagcttccagggctactacatctgcttcatcggcaagcacagcgagcccctgttcgtgcccaccatggaggactacagaagcgccgagctgttcaccagaatggtgctgaaccccagaggcgaggaccacgaccccgaccagaacggccagggcctgatgagaatcgccggccccgtgaccgccaaggtgcccagcaccgagaccaccgagaccatgcagggcatcgccttcgccggcgcccccatgtacagcagcttcagcaccctggtgagaaaggccgaccccgagtacgtgttcagccccggcatcatcgccgagagcaaccacagcgtgtgcgacaagaagaccgtgcccctgacctggaccggcttcctggccgtgagcggcgagatcgagaagatcaccggctgcaccgtgttctgcaccctggccggccccggcgccagctgcgaggcctacagcgagaccggcatcttcaacatcagcagccccacctgcctggtgaacaaggtgcagaagttcagaggcagcgagcagagaatcaacttcatgtgccagagagtggaccaggacgtggtggtgtactgcaacggccagaagaaggtgatcctgaccaagaccctggtgatcggccagtgcatctacaccttcaccagcctgttcagcctgatccccggcgtggcccacagcctggccgtggagctgtgcgtgcccggcctgcacggctgggccaccaccgccctgctgatcaccttctgcttcggctggctgctgatccccgccgtgaccctgatcatcctgaagatcctgagactgctgaccttcagctgcagccactacagcaccgagagcaagttcaaggtgatcctggagagagtgaaggtggagtaccagaagaccatgggcagcatggtgtgcgacatctgccaccacgagtgcgagaccgccaaggagctggagacccacaagaagagctgccccgagggccagtgcccctactgcatgaccatcaccgagagcaccgagagcgccctgcaggcccacttcgccatctgcaagctgaccaacagattccaggagaacctgaagaagagcctgaagagacccgaggtgagaaagggctgctacagaaccctgggcgtgttcagatacaagagcagatgctacgtgggcctggtgtggggcatcctgctgaccaccgagctgatcatctgggccgccagcgccgacacccccctgatggagagcggctggagcgacaccgcccacggcgtgggcatcatccccatgaagaccgacctggagctggacttcgccctggccagcagcagcagctacagctacagaagaaagctggtgaaccccgccaaccaggaggagaccctgcccttccacttccagctggacaagcaggtggtgcacgccgagatccagaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctgcaccgcctgcggcgtgtacctggacaagctgagaagcgtgggcaaggcctacaagatcgtgagcctgaagtacaccagaaaggtgtgcatccagctgggcaccgagcagacctgcaagcacatcgacgtgaacgactgcctggtgacccccagcgtgaaggtgtgcatgatcggcaccatcagcaagctgcagcccggcgacaccctgctgttcctgggccccctggagcagggcggcatcatcctgaagcagtggtgcaccaccagctgcgtgttcggcgaccccggcgacatcatgagcaccaccagcggcatgagatgccccgagcacaccggcagcttcagaaagatctgcggcttcgccaccacccccacctgcgagtaccagggcaacaccgtgagcggcttccagagaatgatggccaccagagacagcttccagagcttcaacgtgaccgagccccacatcaccagcaacagactggagtggatcgaccccgacagcagcatcaaggaccacatcaacatggtgctgaacagagacgtgagcttccaggacctgagcgacaacccctgcaaggtggacctgcacacccagagcatcgacggcgcctggggcagcggcgtgggcttcaccctggtgtgcaccgtgggcctgaccgagtgcgccaacttcatcaccagcatcaaggcctgcgacagcgccatgtgctacggcgccaccgtgaccaacctgctgagaggcagcaacaccgtgaaggtggtgggcaagggcggccacagcggcagcctgttcaagtgctgccacgacaccgactgcaccgaggagggcctggccgccagccccccccacctggacagagtgaccggctacaaccagatcgacagcgacaaggtgtacgacgacggcgcccccccctgcaccatcaagtgctggttcaccaagagcggcgagtggctgctgggcatcctgaacggcaactgggtggtggtggccgtgctgatcgtgatcctgatcctgagcatcctgctgttcagcttcttctgccccgtgagaagcagaaagaacaaggccaactga

SEQ ID NO: 8598 - RNA, 3423 nt, synthetic construct
  misc_feature 1..3423: note = derived and/or modified CDS sequence (opt4) from SNV(1)__JQ690283.1__GP
  source 1..3423: mol_type = other RNA
atggtgggctgggtgtgcatcttcctggtggtgctgaccaccgccaccgccggcctgaccagaaacctgtacgagctgaagatcgagtgcccccacaccgtgggcctgggccagggctacgtgaccggcagcgtggagaccacccccatcctgctgacccaggtggccgacctgaagatcgagagcagctgcaacttcgacctgcacgtgcccgccaccaccacccagaagtacaaccaggtggactggaccaagaagagcagcaccaccgagagcaccaacgccggcgccgccaccttcgaggccaagaccaaggaggtgaacctgaagggcacctgcaacatcccccccaccaccttcgaggccgcctacaagagcagaaagaccgtgatctgctacgacctggcctgcaaccagacccactgcctgcccaccgtgcacctgatcgcccccgtgcagacctgcatgagcgtgagaagctgcatgatcggcctgctgagcagcagaatccaggtgatctacgagaagacctactgcgtgaccggccagctgatcgagggcctgtgcttcatccccacccacaccatcgccctgacccagcccggccacacctacgacaccatgaccctgcccgtgacctgcttcctggtggccaagaagctgggcacccagctgaagctggccgtggagctggagaagctgatcaccggcgtgagctgcaccgagaacagcttccagggctactacatctgcttcatcggcaagcacagcgagcccctgttcgtgcccaccatggaggactacagaagcgccgagctgttcaccagaatggtgctgaaccccagaggcgaggaccacgaccccgaccagaacggccagggcctgatgagaatcgccggccccgtgaccgccaaggtgcccagcaccgagaccaccgagaccatgcagggcatcgccttcgccggcgcccccatgtacagcagcttcagcaccctggtgagaaaggccgaccccgagtacgtgttcagccccggcatcatcgccgagagcaaccacagcgtgtgcgacaagaagaccgtgcccctgacctggaccggcttcctggccgtgagcggcgagatcgagagaatcaccggctgcaccgtgttctgcaccctggccggccccggcgccagctgcgaggcctacagcgagaccggcatcttcaacatcagcagccccacctgcctggtgaacaaggtgcagaagttcagaggcagcgagcagagaatcaacttcatgtgccagagagtggaccaggacgtggtggtgtactgcaacggccagaagaaggtgatcctgaccaagaccctggtgatcggccagtgcatctacaccttcaccagcctgttcagcctgatccccggcgtggcccacagcctggccgtggagctgtgcgtgcccggcctgcacggctgggccaccaccgccctgctgatcaccttctgcttcggctggctgctgatccccaccgtgaccctgatcatcctgaaggtgctgagactgctgaccttcagctgcagccactacagcaccgagagcaagttcaaggtgatcctggagagagtgaaggtggagtaccagaagaccatgggcagcatggtgtgcgacatctgccaccacgagtgcgagaccgccaaggagctggagacccacaagaagagctgccccgagggccagtgcccctactgcatgaccatcaccgagagcaccgagagcgccctgcaggcccacttcagcatctgcaagctgaccaacagattccaggagaacctgaagaagagcctgaagagacccgaggtgagaaagggctgctacagaaccctgggcgtgttcagatacaagagcagatgctacgtgggcctggtgtggggcatcctgctgaccaccgagctgatcatctgggccgccagcgccgacacccccctgatggagagcggctggagcgacaccgcccacggcgtgggcatcatccccatgaagaccgacctggagctggacttcgccctggccagcagcagcagctacagctacagaagaaagctggtgaaccccgccaaccaggaggagaccctgcccttccacttccagctggacaagcaggtggtgcacgccgagatccagaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctgcaccgcctgcggcgtgtacctggacaagctgagaagcgtgggcaaggcctacaagatcgtgagcctgaagtacaccagaaaggtgtgcatccagctgggcaccgagcagacctgcaagcacatcgacgtgaacgactgcctggtgacccccagcgtgaaggtgtgcatgatcggcaccatcagcaagctgcagcccggcgacaccctgctgttcctgggccccctggagcagggcggcatcatcctgaagcagtggtgcaccaccagctgcgtgttcggcgaccccggcgacatcatgagcaccaccagcggcatgagatgccccgagcacaccggcagcttcagaaagatctgcggcttcgccaccacccccacctgcgagtaccagggcaacaccgtgagcggcttccagagaatgatggccaccagagacagcttccagagcttcaacgtgaccgagccccacatcaccagcaacagactggagtggatcgaccccgacagcagcatcaaggaccacatcaacatggtgctgaacagagacgtgagcttccaggacctgagcgacaacccctgcaaggtggacctgcacacccagagcatcgacggcgcctggggcagcggcgtgggcttcaccctggtgtgcaccgtgggcctgaccgagtgcgccaacttcatcaccagcatcaaggcctgcgacagcgccatgtgctacggcgccaccgtgaccaacctgctgagaggcagcaacaccgtgaaggtggtgggcaagggcggccacagcggcagcctgttcaagtgctgccacgacaccgactgcaccgaggagggcctggccgccagccccccccacctggacagagtgaccggctacaaccagatcgacagcgacaaggtgtacgacgacggcgcccccccctgcaccatcaagtgctggttcaccaagagcggcgagtggctgctgggcatcctgaacggcaactgggtggtggtggccgtgctgatcgtgatcctgatcctgagcatcctgctgttcagcttcttctgccccgtgagaaacagaaagaacaaggccaactga

SEQ ID NO: 8599 - RNA, 3423 nt, synthetic construct
  misc_feature 1..3423: note = derived and/or modified CDS sequence (opt4) from SNV(1)__JQ690279.1__GP
  source 1..3423: mol_type = other RNA
atggtgggctgggtgtgcatcttcctggtggtgctgaccaccgccaccgccggcctgaccagaaacctgtacgagctgaagatcgagtgcccccacaccgtgggcctgggccagggctacgtgaccggcagcgtggagaccacccccatcctgctgacccaggtggccgacctgaagatcgagagcagctgcaacttcgacctgcacgtgcccgccaccaccacccagaagtacaaccaggtggactggaccaagaagagcagcaccaccgagagcaccaacgccggcgccaacaccttcgaggccaagaccaaggagatcaacctgaagggcacctgcaacatcccccccaccaccttcgaggccgcctacaagagcagaaagaccgtgatctgctacgacctggcctgcaaccagacccactgcctgcccaccgtgcacctgatcgcccccgtgcagacctgcatgagcgtgagaagctgcatgatcggcctgctgagcagcagaatccaggtgatctacgagaagacctactgcgtgaccggccagctgatcgagggcctgtgcttcatccccacccacaccatcgccctgacccagcccggccacacctacgacaccatgaccctgcccgtgacctgcttcctggtggccaagaagctgggcacccagctgaagctggccgtggagctggagaagctgatcaccggcgtgagctgcaccgagaacagcttccagggctactacatctgcttcatcggcaagcacagcgagcccctgttcgtgcccaccatggaggactacagaagcgccgagctgttcaccagaatggtgctgaaccccagaggcgaggaccacgaccccgaccagaacggccagggcctgatgagaatcgccggccccgtgaccgccaaggtgcccagcaccgagaccaccgagaccatgcagggcatcgccttcgccggcgcccccatgtacagcagcttcagcaccctggtgagaaaggccgaccccgagtacgtgttcagccccggcatcatcgccgagagcaaccacagcgtgtgcgacaagaagaccgtgcccctgacctggaccggcttcctggccgtgagcggcgagatcgagagaatcaccggctgcaccgtgttctgcaccctggccggccccggcgccagctgcgaggcctacagcgagaccggcatcttcaacatcagcagccccacctgcctggtgaacaaggtgcagaagttcagaggcagcgagcagagaatcaacttcatgtgccagagagtggaccaggacgtggtggtgtactgcaacggccagaagaaggtgatcctgaccaagaccctggtgatcggccagtgcatctacaccttcaccagcctgttcagcctgatccccggcgtggcccacagcctggccgtggagctgtgcgtgcccggcctgcacggctgggccaccaccgccctgctgatcaccttctgcttcggctggctgctgatccccaccgtgaccctgctgatcctgaagatcctgagactgctgaccttcagctgcagccactacagcaccgagagcaagttcaaggtgatcctggagagagtgaaggtggagtaccagaagaccatgggcagcatggtgtgcgacatctgccaccacgagtgcgagaccgccaaggagctggagacccacaagaagagctgccccgagggccagtgcccctactgcatgaccatcaccgagagcaccgagagcgccctgcaggcccacttcagcatctgcaagctgaccaacagattccaggagaacctgaagaagagcctgaagagacccgaggtgaagaagggctgctacagaaccctgggcgtgttcagatacaagagcagatgctacgtgggcctggtgtggggcatcctgctgaccaccgagctgatcatctgggccgccagcgccgacacccccctgatggagagcggctggagcgacaccgcccacggcgtgggcatcatccccatgaagagcgacctggagctggacttcgccctggccagcagcagcagctacagctacagaagaaagctggtgaaccccgccaaccaggaggagaccctgcccttccacttccagctggacaagcaggtggtgcacgccgagatccagaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctgcaccgcctgcggcgtgtacctggacaagctgagaagcgtgggcaaggcctacaagatcgtgagcctgaagtacaccagaaaggtgtgcatccagctgggcaccgagcagacctgcaagcacatcgacgtgaacgactgcctggtgacccccagcgtgaaggtgtgcatgatcggcaccatcagcaagctgcagcccggcgacaccctgctgttcctgggccccctggagcagggcggcatcatcctgaagcagtggtgcaccaccagctgcgtgttcggcgaccccggcgacatcatgagcaccaccagcggcatgagatgccccgagcacaccggcagcttcagaaagatctgcggcttcgccaccacccccacctgcgagtaccagggcaacaccgtgagcggcttccagagaatgatggccaccagagacagcttccagagcttcaacgtgaccgagccccacatcaccagcaacagactggagtggatcgaccccgacagcagcatcaaggaccacatcaacatgatcctgaacagagacgtgagcttccaggacctgagcgacaacccctgcaaggtggacctgcacacccagagcatcgacggcgcctggggcagcggcgtgggcttcaccctggtgtgcaccgtgggcctgaccgagtgcgccaacttcatcaccagcatcaaggcctgcgacagcgccatgtgctacggcgccaccgtgaccaacctgctgagaggcagcaacaccgtgaaggtggtgggcaagggcggccacagcggcagcctgttcaagtgctgccacgacaccgactgcaccgaggagggcctggccgccagccccccccacctggacagagtgaccggctacaaccagatcgacagcgacaaggtgtacgacgacggcgcccccccctgcaccatcaagtgctggttcaccaagagcggcgagtggctgctgggcatcctgaacggcaactgggtggtggtggccgtgctgatcgtgatcctgatcctgagcatcctgctgttcagcttcttctgccccgtgagaagcagaaagaacaaggccaactga

SEQ ID NO: 8600 - RNA, 3423 nt, synthetic construct
  misc_feature 1..3423: note = derived and/or modified CDS sequence (opt4) from SNV(2)__JQ690284.1__GP
  source 1..3423: mol_type = other RNA
atggtgggctgggtgtgcatcttcctggtggtgctgaccaccgccaccgccggcctgaccagaaacctgtacgagctgaagatcgagtgcccccacaccgtgggcctgggccagggctacgtgaccggcagcgtggagaccacccccatcctgctgacccaggtggccgacctgaagatcgagagcagctgcaacttcgacctgcacgtgcccgccaccaccacccagaagtacaaccaggtggactggaccaagaagggcagcaccaccgagagcaccaacgccggcgccaacaccttcgaggccaagaccaaggaggtgaacctgaagggcacctgcaacatcccccccaccaccttcgaggccgcctacaagagcagaaagaccgtgatctgctacgacctggcctgcaaccagacccactgcctgcccaccgtgcacctgatcgcccccgtgcagacctgcatgagcgtgagaagctgcatgatcggcctgctgagcagcagaatccaggtgatctacgagaagacctactgcgtgaccggccagctgatcgagggcctgtgcttcatccccacccacaccatcgccctgacccagcccggccacacctacgacaccatgaccctgcccgtgacctgcttcctggtggccaagaagctgggcacccagctgaagctggccgtggagctggagaagctgatcaccggcgtgagctgcaccgagaacagcttccagggctactacatctgcttcatcggcaagcacagcgagcccctgttcgtgcccaccatggaggactacagaagcgccgaggtgttcaccagaatggtgctgaaccccagaggcgaggaccacgaccccgaccagaacggccagggcctgatgagaatcgccggccccgtgaccgccaaggtgcccagcaccgagaccaccgagaccatgcagggcatcgccttcgccggcgcccccatgtacagcagcttcagcaccctggtgagaaaggccgaccccgagtacgtgttcagccccggcatcatcgccgagagcaaccacagcgtgtgcgacaagaagaccgtgcccctgacctggaccggcttcctggccgtgagcggcgagatcgagagaatcaccggctgcaccgtgttctgcaccctggccggccccggcgccagctgcgaggcctacagcgagaccggcatcttcaacatcagcagccccacctgcctggtgaacaaggtgcagaagttcagaggcagcgagcagagaatcaacttcatgtgccagagagtggaccaggacgtggtggtgtactgcaacggccagaagaaggtgatcctgaccaagaccctggtgatcggccagtgcatctacaccttcaccagcctgttcagcctgatccccggcgtggcccacagcctggccgtggagctgtgcgtgcccggcctgcacggctgggccaccaccgccctgctgatcaccttctgcttcggctggctgctgatccccaccgtgaccctgatcatcctgaagatcctgagactgctgaccttcagctgcagccactacagcaccgagagcaagttcaaggtgatcctggagagagtgaaggtggagtaccagaagaccatgggcagcatggtgtgcgacatctgccaccacgagtgcgagaccgccaaggagctggagacccacaagaagagctgccccgagggccagtgcccctactgcatgaccatcaccgagagcaccgagagcgccctgcaggcccacttcagcatctgcaagctgaccaacagattccaggagaacctgaagaagagcctgaagagacccgaggtgaagaagggctgctacagaaccctgggcgtgttcagatacaagagcagatgctacgtgggcctggtgtggggcatcctgctgaccaccgagctgatcatctgggccgccagcgccgacacccccctgatggagagcggctggagcgacaccgcccacggcgtgggcatcatccccatgaagaccgacctggagctggacttcgccctggccagcagcagcagctacagctacagaagaaagctggtgaaccccgccaaccaggaggagaccctgcccttccacttccagctggacaagcaggtggtgcacgccgagatccagaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctgcaccgcctgcggcgtgtacctggacaagctgagaagcgtgggcaaggcctacaagatcgtgagcctgaagtacaccagaaaggtgtgcatccagctgggcaccgagcagacctgcaagcacatcgacgtgaacgactgcctggtgacccccagcgtgaaggtgtgcatgatcggcaccatcagcaagctgcagcccggcgacaccctgctgttcctgggccccctggagcagggcggcatcatcctgaagcagtggtgcaccaccagctgcgtgttcggcgaccccggcgacatcatgagcaccaccagcggcatgagatgccccgagcacaccggcagcttcagaaagatctgcggcttcgccaccacccccacctgcgagtaccagggcaacaccgtgagcggcttccagagaatgatggccaccagagacagcttccagagcttcaacgtgaccgagccccacatcaccagcaacagactggagtggatcgaccccgacagcagcatcaaggaccacatcaacatggtgctgaacagagacgtgagcttccaggacctgagcgacaacccctgcaaggtggacctgcacacccagagcatcgacggcgcctggggcagcggcgtgggcttcaccctggtgtgcaccgtgggcctgaccgagtgcgccaacttcatcaccagcatcaaggcctgcgacagcgccatgtgctacggcgccaccgtgaccaacctgctgagaggcagcaacaccgtgaaggtggtgggcaagggcggccacagcggcagcctgttcaagtgctgccacgacaccgactgcaccgaggagggcctggccgccagccccccccacctggacagagtgaccggctacaaccagatcgacagcgacaaggtgtacgacgacggcgcccccccctgcaccatcaagtgctggttcaccaagagcggcgagtggctgctgggcatcctgaacggcaactgggtggtggtggccgtgctgatcgtgatcctgatcctgagcatcctgctgttcagcttcttctgccccgtgagaagcagaaagaacaaggccaactga

SEQ ID NO: 8601 - RNA, 3423 nt, synthetic construct
  misc_feature 1..3423: note = derived and/or modified CDS sequence (opt4) from SNV(2)__JQ690280.1__GP
  source 1..3423: mol_type = other RNA
atggtgggctgggtgtgcatcttcctggtggtgctgaccaccgccaccgccggcctgaccagaaacctgtacgagctgaagatcgagtgcccccacaccgtgggcctgggccagggctacgtgaccggcagcgtggagaccacccccatcctgctgacccaggtggccgacctgaagatcgagagcagctgcaacttcgacctgcacgtgcccgccaccaccacccagaagtacaaccaggtggactggaccaagaagagcagcaccaccgagagcaccaacgccggcgccaacaccttcgaggccaagaccaaggaggtgaacctgaagggcacctgcaacatcccccccaccaccttcgaggccgcctacaagagcagaaagaccgtgatctgctacgacctggcctgcaaccagacccactgcctgcccaccgtgcacctgatcgcccccgtgcagacctgcatgagcgtgagaagctgcatgatcggcctgctgagcagcagaatccaggtgatctacgagaagacctactgcgtgaccggccagctgatcgagggcctgtgcttcatccccacccacaccatcgccctgacccagcccggccacacctacgacaccatgaccctgcccgtgacctgcttcctggtggccaagaagctgggcacccagctgaagctggccgtggagctggagaagctgatcaccggcgtgagctgcaccgagaacagcttccagggctactacatctgcttcatcggcaagcacagcgagcccctgttcgtgcccaccatggaggactacagaagcgccgagctgttcaccagaatggtgctgaaccccagaggcgaggaccacgaccccgaccagaacggccagggcctgatgagaatcgccggccccgtgaccgccaaggtgcccagcaccgagaccaccgagaccatgcagggcatcgccttcgccggcgcccccatgtacagcagcttcagcaccctggtgagaaaggccgaccccgagtacgtgttcagccccggcatcatcgccgagagcaaccacagcgtgtgcgacaagaagaccgtgcccctgacctggaccggcttcctggccgtgagcggcgagatcgagagaatcaccggctgcaccgtgttctgcaccctggccggccccggcgccagctgcgaggcctacagcgagaccggcatcttcaacatcagcagccccacctgcctggtgaacaaggtgcagaagttcagaggcagcgagcagagaatcaacttcatgtgccagagagtggaccaggacgtggtggtgtactgcaacggccagaagaaggtgatcctgaccaagaccctggtgatcggccagtgcatctacaccttcaccagcctgttcagcctgatccccggcgtggcccacagcctggccgtggagctgtgcgtgcccggcctgcacggctgggccaccaccgccctgctgatcaccttctgcttcggctggctgctgatccccaccgtgaccctgatcatcctgaagatcctgagactgctgaccttcagctgcagccactacagcaccgagagcaagttcaaggtgatcctggagagagtgaaggtggagtaccagaagaccatgggcagcatggtgtgcgacatctgccaccacgagtgcgagaccgccaaggagctggagacccacaagaagagctgccccgagggccagtgcccctactgcatgaccatcaccgagagcaccgagagcgccctgcaggcccacttcagcatctgcaagctgaccaacagattccaggagaacctgaagaagagcctgaagagacccgaggtgaagaagggctgctacagaaccctgggcgtgttcagatacaagagcagatgctacgtgggcctggtgtggggcatcctgctgaccaccgagctgatcatctgggccgccagcgccgacacccccctgatggagagcggctggagcgacaccgcccacggcgtgggcatcatccccatgaagaccgacctggagctggacttcgccctggccagcagcagcagctacagctacagaagaaagctggtgaaccccgccaaccaggaggagaccctgcccttccacttccagctggacaagcaggtggtgcacgccgagatccagaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctgcaccgcctgcggcgtgtacctggacaagctgagaagcgtgggcaaggcctacaagatcgtgagcctgaagtacaccagaaaggtgtgcatccagctgggcaccgagcagacctgcaagcacatcgacgtgaacgactgcctggtgacccccagcgtgaaggtgtgcatgatcggcaccatcagcaagctgcagcccggcgacaccctgctgttcctgggccccctggagcagggcggcatcatcctgaagcagtggtgcaccaccagctgcgtgttcggcgaccccggcgacatcatgagcaccaccagcggcatgagatgccccgagcacaccggcagcttcagaaagatctgcggcttcgccaccacccccacctgcgagtaccagggcaacaccgtgagcggcttccagagaatgatggccaccagagacagcttccagagcttcaacgtgaccgagccccacatcaccagcaacagactggagtggatcgaccccgacagcagcatcaaggaccacatcaacatggtgctgaacagagacgtgagcttccaggacctgagcgacaacccctgcaaggtggacctgcacacccagagcatcgacggcgcctggggcagcggcgtgggcttcaccctggtgtgcaccgtgggcctgaccgagtgcgccaacttcatcaccagcatcaaggcctgcgacagcgccatgtgctacggcgccaccgtgaccaacctgctgagaggcagcaacaccgtgaaggtggtgggcaagggcggccacagcggcagcctgttcaagtgctgccacgacaccgactgcaccgaggagggcctggccgccagccccccccacctggacagagtgaccggctacaaccagatcgacagcgacaaggtgtacgacgacggcgcccccccctgcaccatcaagtgctggttcaccaagagcggcgagtggctgctgggcatcctgaacggcaactgggtggtggtggccgtgctgatcgtgatcctgatcctgagcatcctgctgttcagcttcttctgccccgtgagaagcagaaagaacaaggccaactga

SEQ ID NO: 8602 - RNA, 3423 nt, synthetic construct
  misc_feature 1..3423: note = derived and/or modified CDS sequence (opt4) from SNV(CC107/POR)__KT885045.1__GP
  source 1..3423: mol_type = other RNA
atggtgggctgggtgtgcatcttcctggtggtgctgaccaccgccaccgccggcctgaccagaaacctgtacgagctgaagatcgagtgcccccacaccgtgggcctgggccagggctacgtgaccggcagcgtggagaccacccccatcctgctgacccaggtggccgacctgaagatcgagagcagctgcaacttcgacctgcacgtgcccgccaccaccacccagaagtacaaccaggtggactggaccaagaagagcagcaccaccgagagcaccaacgccggcgccaccaccttcgaggccaagaccaaggaggtgaacctgaagggcacctgcaacatcccccccaccaccttcgaggccgcctacaagagcagaaagaccgtgatctgctacgacctggcctgcaaccagacccactgcctgcccaccgtgcacctgatcgcccccgtgcagacctgcatgagcgtgagaagctgcatgatcggcctgctgagcagcagaatccaggtgatctacgagaagacctactgcgtgaccggccagctgatcgagggcctgtgcttcatccccacccacaccatcgccctgacccagcccggccacacctacgacaccatgaccctgcccgtgacctgcttcctggtggccaagaagctgggcacccagctgaagctggccgtggagctggagaagctgatcaccggcgtgagctgcaccgagaacagcttccagggctactacatctgcttcatcggcaagcacagcgagcccctgttcgtgcccaccatggaggactacagaagcgccgagctgttcaccagaatggtgctgaaccccagaggcgaggaccacgaccccgaccagaacggccagggcctgatgagaatcgccggccccgtgaccgccaaggtgcccagcaccgagaccaccgagaccatgcagggcatcgccttcgccggcgcccccatgtacagcagcttcagcaccctggtgagaaaggccgaccccgagtacgtgttcagccccggcatcatcgccgagagcaaccacagcgtgtgcgacaagaagaccgtgcccctgacctggaccggcttcctggccgtgagcggcgagatcgagagaatcaccggctgcaccgtgttctgcaccctggccggccccggcgccagctgcgaggcctacagcgagaccggcatcttcaacatcagcagccccacctgcctggtgaacaaggtgcagaagttcagaggcagcgagcagagaatcaacttcatgtgccagagagtggaccaggacgtggtggtgtactgcaacggccagaagaaggtgatcctgaccaagaccctggtgatcggccagtgcatctacaccttcaccagcctgttcagcctgatccccggcgtggcccacagcctggccgtggagctgtgcgtgcccggcctgcacggctgggccaccaccgccctgctgatcaccttctgcttcggctggctgctgatccccaccgtgaccctgatcatcctgaagatcctgagactgctgaccttcagctgcagccactacagcaccgagagcaagttcaaggtgatcctggagagagtgaaggtggagtaccagaagaccatgggcagcatggtgtgcgacatctgccaccacgagtgcgagaccgccaaggagctggagacccacaagaagagctgccccgagggccagtgcccctactgcatgaccatcaccgagagcaccgagagcgccctgcaggcccacttcagcatctgcaagctgaccaacagattccaggagaacctgaagaagagcctgaagagacccgaggtgagaaagggctgctacagaaccctgggcgtgttcagatacaagagcagatgctacgtgggcctggtgtggggcatcctgctgaccaccgagctgatcatctgggccgccagcgccgacacccccctgatggagagcggctggagcgacaccgcccacggcgtgggcatcgtgcccatgaagaccgacctggagctggacttcgccctggccagcagcagcagctacagctacagaagaaagctggtgaaccccgccaaccaggaggagaccctgcccttccacttccagctggacaagcaggtggtgcacgccgagatccagaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctgcaccgcctgcggcgtgtacctggacaagctgagaagcgtgggcaaggcctacaagatcgtgagcctgaagtacaccagaaaggtgtgcatccagctgggcaccgagcagacctgcaagcacatcgacgtgaacgactgcctggtgacccccagcgtgaaggtgtgcatgatcggcaccatcagcaagctgcagcccggcgacaccctgctgttcctgggccccctggagcagggcggcatcatcctgaagcagtggtgcaccaccagctgcgtgttcggcgaccccggcgacatcatgagcaccaccagcggcatgagatgccccgagcacaccggcagcttcagaaagatctgcggcttcgccaccacccccacctgcgagtaccagggcaacaccgtgagcggcttccagagaatgatggccaccagagacagcttccagagcttcaacgtgaccgagccccacatcaccagcaacagactggagtggatcgaccccgacagcagcatcaaggaccacatcaacatggtgctgaacagagacgtgagcttccaggacctgagcgacaacccctgcaaggtggacctgcacacccagagcatcgacggcgcctggggcagcggcgtgggcttcaccctggtgtgcaccgtgggcctgaccgagtgcgccaacttcatcaccagcatcaaggcctgcgacagcgccatgtgctacggcgccaccgtgaccaacctgctgagaggcagcaacaccgtgaaggtggtgggcaagggcggccacagcggcagcctgttcaagtgctgccacgacaccgactgcaccgaggagggcctggccgccagccccccccacctggacagagtgaccggctacaaccagatcgacagcgacaaggtgtacgacgacggcgcccccccctgcaccatcaagtgctggttcaccaagagcggcgagtggctgctgggcatcctgaacggcaactgggtggtggtggccgtgctgatcgtgatcctgatcctgagcatcctgctgttcagcttcttctgccccgtgagaaacagaaagaacaaggccaactga

SEQ ID NO: 8603 - RNA, 3423 nt, synthetic construct
  misc_feature 1..3423: note = derived and/or modified CDS sequence (opt4) from HPS(Convict Creek 107)__L33474.1__GP
  source 1..3423: mol_type = other RNA
atggtgggctgggtgtgcatcttcctggtggtgctgaccaccgccaccgccggcctgaccagaaacctgtacgagctgaagatcgagtgcccccacaccgtgggcctgggccagggctacgtgaccggcagcgtggagaccacccccatcctgctgacccaggtggccgacctgaagatcgagagcagctgcaacttcgacctgcacgtgcccgccaccaccacccagaagtacaaccaggtggactggaccaagaagagcagcaccaccgagagcaccaacgccggcgccaccaccttcgaggccaagaccaaggaggtgaacctgaagggcacctgcaacatcccccccaccaccttcgaggccgcctacaagagcagaaagaccgtgatctgctacgacctggcctgcaaccagacccactgcctgcccaccgtgcacctgatcgcccccgtgcagacctgcatgagcgtgagaagctgcatgatcggcctgctgagcagcagaatccaggtgatctacgagaagacctactgcgtgaccggccagctgatcgagggcctgtgcttcatccccacccacaccatcgccctgacccagcccggccacacctacgacaccatgaccctgcccgtgacctgcttcctggtggccaagaagctgggcacccagctgaagctggccgtggagctggagaagctgatcaccggcgtgagctgcaccgagaacagcttccagggctactacatctgcttcatcggcaagcacagcgagcccctgttcgtgcccaccatggaggactacagaagcgccgagctgttcaccagaatggtgctgaaccccagaggcgaggaccacgaccccgaccagaacggccagggcctgatgagaatcgccggccccgtgaccgccaaggtgcccagcaccgagaccaccgagaccatgcagggcatcgccttcgccggcgcccccatgtacagcagcttcagcaccctggtgagaaaggccgaccccgagtacgtgttcagccccggcatcatcgccgagagcaaccacagcgtgtgcgacaagaagaccgtgcccctgacctggaccggcttcctggccgtgagcggcgagatcgagagaatcaccggctgcaccgtgttctgcaccctggccggccccggcgccagctgcgaggcctacagcgagaccggcatcttcaacatcagcagccccacctgcctggtgaacaaggtgcagaagttcagaggcagcgagcagagaatcaacttcatgtgccagagagtggaccaggacgtggtggtgtactgcaacggccagaagaaggtgatcctgaccaagaccctggtgatcggccagtgcatctacaccttcaccagcctgttcagcctgatccccggcgtggcccacagcctggccgtggagctgtgcgtgcccggcctgcacggctgggccaccaccgccctgctgatcaccttctgcttcggctggctgctgatccccaccgtgaccctgatcatcctgaagatcctgagactgctgaccttcagctgcagccactacagcaccgagagcaagttcaaggtgatcctggagagagtgaaggtggagtaccagaagaccatgggcagcatggtgtgcgacatctgccaccacgagtgcgagaccgccaaggagctggagacccacaagaagagctgccccgagggccagtgcccctactgcatgaccatcaccgagagcaccgagagcgccctgcaggcccacttcagcatctgcaagctgaccaacagattccaggagatcctgaagaagagcctgaagagacccgaggtgagaaagggctgctacagaaccctgggcgtgttcagatacaagagcagatgctacgtgggcctggtgtggggcatcctgctgaccaccgagctgatcatctgggccgccagcgccgacacccccctgatggagagcggctggagcgacaccgcccacggcgtgggcatcgtgcccatgaagaccgacctggagctggacttcgccctggccagcagcagcagctacagctacagaagaaagctggtgaaccccgccaaccaggaggagaccctgcccttccacttccagctggacaagcaggtggtgcacgccgagatccagaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctgcaccgcctgcggcgtgtacctggacaagctgagaagcgtgggcaaggcctacaagatcgtgagcctgaagtacaccagaaaggtgtgcatccagctgggcaccgagcagacctgcaagcacatcgacgtgaacgactgcctggtgacccccagcgtgaaggtgtgcatgatcggcaccatcagcaagctgcagcccggcgacaccctgctgttcctgggccccctggagcagggcggcatcatcctgaagcagtggtgcaccaccagctgcgtgttcggcgaccccggcgacatcatgagcaccaccagcggcatgagatgccccgagcacaccggcagcttcagaaagatctgcggcttcgccaccacccccacctgcgagtaccagggcaacaccgtgagcggcttccagagaatgatggccaccagagacagcttccagagcttcaacgtgaccgagccccacatcaccagcaacagactggagtggatcgaccccgacagcagcatcaaggaccacatcaacatggtgctgaacagagacgtgagcttccaggacctgagcgacaacccctgcaaggtggacctgcacacccagagcatcgacggcgcctggggcagcggcgtgggcttcaccctggtgtgcaccgtgggcctgaccgagtgcgccaacttcatcaccagcatcaaggcctgcgacagcgccatgtgctacggcgccaccgtgaccaacctgctgagaggcagcaacaccgtgaaggtggtgggcaagggcggccacagcggcagcctgttcaagtgctgccacgacaccgactgcaccgaggagggcctggccgccagccccccccacctggacagagtgaccggctacaaccagatcgacagcgacaaggtgtacgacgacggcgcccccccctgcaccatcaagtgctggttcaccagaagcggcgagtggctgctgggcatcctgaacggcaactgggtggtggtggccgtgctgatcgtgatcctgatcctgagcatcctgctgttcagcttcttctgccccgtgagaaacagaaagaacaaggccaactga

SEQ ID NO: 8604 - RNA, 3423 nt, synthetic construct
  misc_feature 1..3423: note = derived and/or modified CDS sequence (opt4) from HPS(Convict Creek 74)__L33684.1__GP
  source 1..3423: mol_type = other RNA
atggtgggctgggtgtgcatcttcctggtggtgctgaccaccgccaccgccggcctgaccagaaacctgtacgagctgaagatcgagtgcccccacaccgtgggcctgggccagggctacgtgaccggcagcgtggagaccacccccatcctgctgacccaggtggccgacctgaagatcgagagcagctgcaacttcgacctgcacgtgcccgccaccaccacccagaagtacaaccaggtggactggaccaagaagagcagcaccaccgagagcaccaacgccggcgccaccaccttcgaggccaagaccaaggaggtgaacctgaagggcacctgcaacatcccccccaccaccttcgaggccgccttcaagagcagaaagaccgtgatctgctacgacctggcctgcaaccagacccactgcctgcccaccgtgcacctgatcgcccccgtgcagacctgcatgagcgtgagaagctgcatgatcggcctgctgagcagcagaatccaggtgatctacgagaagacctactgcgtgaccggccagctgatcgagggcctgtgcttcatccccacccacaccatcgccctgacccagcccggccacacctacgacaccatgaccctgcccgtgacctgcttcctggtggccaagaagctgggcacccagctgaagctggccgtggagctggagaagctgatcaccggcgtgagctgcaccgagaacagcttccagggctactacatctgcttcatcggcaagcacagcgagcccctgttcgtgcccaccatggaggactacagaagcgccgagctgttcaccagaatggtgctgaaccccagaggcgaggaccacgaccccgaccagaacggccagggcctgatgagaatcgccggccccgtgaccgccaaggtgcccagcaccgagaccaccgagaccatgcagggcatcgccttcgccggcgcccccatgtacagcagcttcagcaccctggtgagaaaggccgaccccgagtacgtgttcagccccggcatcatcgccgagagcaaccacagcgtgtgcgacaagaagaccgtgcccctgacctggaccggcttcctggccgtgagcggcgagatcgagagaatcaccggctgcaccgtgttctgcaccctggccggccccggcgccagctgcgaggcctacagcgagaccggcatcttcaacatcagcagccccacctgcctggtgaacaaggtgcagaagttcagaggcagcgagcagagaatcaacttcatgtgccagagagtggaccaggacgtggtggtgtactgcaacggccagaagaaggtgatcctgaccaagaccctggtgatcggccagtgcatctacaccttcaccagcctgttcagcctgatccccggcgtggcccacagcctggccgtggagctgtgcgtgcccggcctgcacggctgggccaccaccgccctgctgatcaccttctgcttcggctggctgctgatccccaccgtgaccctgatcatcctgaagatcctgagactgctgaccttcagctgcagccactacagcaccgagagcaagttcaaggtgatcctggagagagtgaaggtggagtaccagaagaccatgggcagcatggtgtgcgacatctgccaccacgagtgcgagaccgccaaggagctggagacccacaagaagagctgccccgagggccagtgcccctactgcatgaccatcaccgagagcaccgagagcgccctgcaggcccacttcagcatctgcaagctgaccaacagattccaggagatcctgaagaagagcctgaagagacccgaggtgagaaagggctgctacagaaccctgggcgtgttcagatacaagagcagatgctacgtgggcctggtgtggggcatcctgctgaccaccgagctgatcatctgggccgccagcgccgacacccccctgatggagagcggctggagcgacaccgcccacggcgtgggcatcgtgcccatgaagaccgacctggagctggacttcgccctggccagcagcagcagctacagctacagaagaaagctggtgaaccccgccaaccaggaggagaccctgcccttccacttccagctggacaagcaggtggtgcacgccgagatccagaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctgcaccgcctgcggcgtgtacctggacaagctgagaagcgtgggcaaggcctacaagatcgtgagcctgaagtacaccagaaaggtgtgcatccagctgggcaccgagcagacctgcaagcacatcgacgtgaacgactgcctggtgacccccagcgtgaaggtgtgcatgatcggcaccatcagcaagctgcagcccggcgacaccctgctgttcctgggccccctggagcagggcggcatcatcctgaagcagtggtgcaccaccagctgcgtgttcggcgaccccggcgacatcatgagcaccaccagcggcatgagatgccccgagcacaccggcagcttcagaaagatctgcggcttcgccaccacccccacctgcgagtaccagggcaacaccgtgagcggcttccagagaatgatggccaccagagacagcttccagagcttcaacgtgaccgagccccacatcaccagcaacagactggagtggatcgaccccgacagcagcatcaaggaccacatcaacatggtgctgaacagagacgtgagcttccaggacctgagcgacaacccctgcaaggtggacctgcacacccagagcatcgacggcgcctggggcagcggcgtgggcttcaccctggtgtgcaccgtgggcctgaccgagtgcgccaacttcatcaccagcatcaaggcctgcgacagcgccatgtgctacggcgccaccgtgaccaacctgctgagaggcagcaacaccgtgaaggtggtgggcaagggcggccacagcggcagcctgttcaagtgctgccacgacaccgactgcaccgaggagggcctggccgccagccccccccacctggacagagtgaccggctacaaccagatcgacagcgacaaggtgtacgacgacggcgcccccccctgcaccatcaagtgctggttcaccaagagcggcgagtggctgctgggcatcctgaacggcaactgggtggtggtggccgtgctgatcgtgatcctgatcctgagcatcctgctgttcagcttcttctgccccgtgagaaacagaaagaacaaggccaactga

SEQ ID NO: 8605 - RNA, 3423 nt, synthetic construct
  misc_feature 1..3423: note = derived and/or modified CDS sequence (opt4) from BRV(Indiana)__AF030551.1__GP
  source 1..3423: mol_type = other RNA
atggtgggctgggtgtgcatcttcctggtggtgctgaccaccgccaccgccggcctgaccagaaacctgtacgagctgaagatcgagtgcccccacaccgtgggcctgggccagggctacgtgaccggcagcgtggagaccacccccgtgcccctgggccaggtgaccgacctgaagatcgagagcagctgcaacttcgacctgcacgtgcccagcaccaccatccagaagtacaaccaggtggagtgggccaagaagaccagcaccaccgagagcaccaacgccggcgccagcaccttcgaggccaagaccaaggaggtgaacctgaagggcacctgcaacatccccgtgaccaccttcgaggccgcctacaagagcagaaagaccgtgatctgctacgacctggcctgcaaccagacccactgcctgcccaccgtgcacctgatcgcccccgtgcagacctgcatgagcgtgagaagctgcatgatcggcctgctgagcagcagaatccacgtgatctacgagaagacctactgcgtgaccggccaggtggtggagggcctgtgcttcatccccacccacaccatcgccctgacccagcccggccacacctacgacaccatgaccctgcccatcacctgcttcctggtggccaagaagctgggcacccagctgaagatcgccgtggagctggagaagctgatcaccgccagcggctgcaccgagaacagcttccagggctactacatctgcttcctgggcaagcacagcgagcccctgtacgtgcccaccatggacgactacagaagcgccgagctgttcaccagaatggtgctgaaccccaagggcgaggaccacgaccccgaccaggacggccagggcctgatgagaatcaccggccccatcaccgccaaggtgcccagcaccgagaccaccgagaccatgcagggcgtggccttcgccggcacccccatgtacagcagcttcagcaccctgctgagaaaggccgaccccgagtacgtgttcagccccggcatcatccccgagagcaaccacagcgtgtgcgacaagaagaccatgcccatcacctggaccggcttcctggccgtgagcggcgagatcgagaagatcaccggctgcaccgtgttctgcaccctggccggccccggcgccagctgcgaggcctacagcgagaccggcatcttcaacatcagcagccccacctgcctggtgaacaaggtgcagaagttcagaggcagcgagcagagagtgaacttcatgtgccagagagtggaccaggacgtggtggtgtactgcaacggccagaagaaggtgatcctgaccaagaccctggtgatcggccagtgcatctacaccttcaccagcctgttcagcctgctgcccggcgtggcccacagcctggccgtggagctgtgcgtgcccggcctgcacggctgggccaccaccgccctgctgatcaccttctgcttcggctggctgctgatccccagcgtgaccctgatcatcctgagaatcctgagactgctgaccttcagctgcagccactacagcaccgagagcaagttcaagatcctgctggagaaggtgaaggtggagtaccagaagaccatgggcagcatggtgtgcgacatctgccaccacgagtgcgagaccgccaaggagctggacacccacagaaagagctgccccgagggccagtgcccctactgcatgaccatgaccgagagcaccgagagcgccctgcaggcccacttcagcgtgtgcaagctgaccaacagattccaggagaacctgaagaagagcctgaagcaccccgaggtgaagcagggctgctacagaaccctgggcgtgttcagatacaagagcagatgctacgtgggcctggtgtggggcatcctgctgaccgccgagctgatcatctgggccgccagcgccgagacccccctgatggagagcggctggagcgacaccgcccacggcgtgggcatcgtgcccatgaagaccgacctggagctggacttcgccctggccagcagcagcagctacagctacagaagaaagctggtgaaccccgccaacagcgaggagaccctgcccttccacctgcagctggagaagcaggtggtgcacgccgagatccacaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctggaccgcctgcggcgtgtacctggacaagctgagaagcgtgggcaaggcctacaagatcgtgagcctgaagtacaccagaaaggtgtgcatccagctgggcaccgagcagacctgcaagcacatcgacgtgaacgactgcctggtgacccccagcgtgaaggtgtgcatgatcggcaccgtgagcaagctgcagcccggcgacaccctgctgttcctgggccccctggagcagggcggcatcatcctgaagcagtggtgcaccaccagctgcgtgttcggcgaccccggcgacatcatgagcaccaccagcggcatgaagtgccccgagcacaccggcagcttcagaaagatctgcggcttcgccaccacccccacctgcgagtaccagggcaacaccgtgagcggcttcaagagaatgatggccaccagagacagcttccagagcttcaacgtgaccgagccccacatcaccagcaacagactggagtggatcgaccccgacagcagcatcaaggaccacatcaacgtggtgctgaacagagacgtgagcttccaggacctgagcgacaacccctgcaaggtggacctgcacacccagagcatcgacggcgcctggggcagcggcgtgggcttcaccctggtgtgcaccgtgggcctgaccgagtgcgccaacttcatcaccagcatcaaggcctgcgacctggccatgtgctacggcgccaccgtgaccaacctgctgagaggcagcaacaccgtgaaggtggtgggcaagggcggccacagcggcagcctgttcaagtgctgccacgacaccgactgcaccgacgagggcctggccgccagccccccccacctggacagagtgaccggcttcaaccagatcgacagcgacaaggtgtacgacgacggcgcccccccctgcagcgtgaagtgctggttcaccaagagcggcgagtggctgctgagaatcctgaacggcaactggatggtggtggccgtgctgatcgtgatcctgatcctgagcatcctgctgttcagcttcttctgccccatcagaagcagaaagagcaagcccaactga

SEQ ID NO: 8606 - RNA, 3423 nt, synthetic construct
  misc_feature 1..3423: note = derived and/or modified CDS sequence (opt4) from BRV(Oklahoma)__AF030552.1__GP
  source 1..3423: mol_type = other RNA
atggtgggctgggtgtgcatcttcctggtggtgctgaccaccagcaccgccggcctgaccagaaacctgtacgagctgaagatcgagtgcccccacaccgtgggcctgggccagggctacgtgaccggcagcgtggagatcacccccgtgcccctgggccaggtgaccgacctgaagatcgagagcagctgcaacttcgacctgcacgtgcccagcaccaccatccagaagtacacccaggtggagtgggccaagaagagcagcaccaccgagagcaccaacgccgccgccaccaccttcgaggccaagaccaaggaggtgagcctgaagggcacctgcaacatccccgtgaccaccttcgaggccgcctacaagagcagaaagaccgtgatctgctacgacctggcctgcaaccagacccactgcctgcccaccgtgcacctgatcgcccccgtgcagacctgcatgagcgtgagaagctgcatggtgggcctgctgagcagcagaatccaggtgatctacgagaagacctactgcgtgaccggccagctggtggagggcctgtgcttcatccccacccacaccatcgccctgacccagcccggccacacctacgacaccatgaccctgcccatcacctgcttcctggtggccaagaagctgggcacccagctgaagatcgccgtggagctggagaagctgatcaccgccagcggctgcaccgagaacagcttccagggctactacatctgcttcctgggcaagcacagcgagcccatgtacgtgcccaccatggacgactacagaagcgccgagctgttcaccagaatggtgctgaaccccaagggcgaggaccacgaccccgaccagaacggccagggcctgatgagaatcgccggccccatcaccgccaaggtgcccagcaccgagaccaccgagaccatgcagggcatcgccttcgccggcgcccccatgtacagcaccttcgccaccctggtgagaaaggccgaccccgagtacgtgttcagccccggcatcatccccgagagcaaccacagcgtgtgcgacaagaagaccatgcccatcacctggaccggcttcctggccctgagcggcgagatcgagagaatcaccggctgcaccgtgttctgcaccctggccggccccggcgccagctgcgaggcctacagcgagaccggcatcttcaacatcagcagccccacctgcctggtgaacaaggtgcagaagttcagaggcagcgagcagagaatcaacttcatgtgccagagagtggaccaggacgtggtggtgtactgcaacggccagaagaaggtgatcctgaccaagaccctggtgatcggccagtgcatctacaccttcaccagcctgttcagcctgctgcccggcgtggcccacagcctggccgtggagctgtgcgtgcccggcctgcacggctgggccaccaccgccctgctgatcaccttctgcttcggctggctgctgatccccgccatcaccctgatcgtgctgaagatcctgagactgctgaccttcagctgcagccactacagcaaggagagcagattcaagatcctgctggagaaggtgaaggtggagtaccagaagaccatgggcagcatggtgtgcgacatctgccaccacgactgcgagaccgccaaggagctggacacccacaagaagagctgccccgagggccagtgcccctactgcatgaccatgaccgagagcaccgagagcgccctgcaggcccacttcagcgtgtgcaagctgaccaacagattccaggagaacctgaagaagagcctgaagcaccccgaggtgaagcagggctgctacagaaccctgggcgtgttcagatacaagagcagatgctacgtgggcctggtgtggggcctgctgctgaccaccgagctgatcatctgggccgccagcgccgagacccccctgatggagagcggctggagcgacaccgcccacggcgtgggcatcgtgcccatgagaaccgacctggagctggacttcgccctggccagcagcagcagctacagctacagaagaaagctggtgaaccccgccaacaccgaggagaccctgcccttccacctgcagctggagaagcaggtggtgcacgccgagatccagaacctgggccactggatggacggcaccttcaacatcaagaccgccttccactgctacggcgagtgcaagaagtacgcctacccctggcagaccgccaagtgcttcttcgagaaggactaccagtacgagaccagctggggctgcaacccccccgactgccccggcgtgggcaccggctgcaccgcctgcggcgtgtacctggacaagctgagaagcgtgggcaaggcctacaagatcgtgagcctgaagtacaccagaaaggtgtgcatccagctgggcaccgagcagacctgcaagcacatcgacgtgaacgactgcctggtgagccccagcgtgaaggtgtgcatgatcggcaccgtgagcaagctgcagcccggcgacaccctgctgttcctgggccccctggagcagggcggcatcatcctgaagcagtggtgcaccaccagctgcgtgttcggcgaccccggcgacatcatgagcaccaccagcggcatgagatgccccgagcacaccggcagcttcagaaagatctgcggcttcgccaccacccccacctgcgagtaccagggcaacaccatcagcggcttcaagagaatgatggccaccagagacagcttccagagcttcaacgtgaccgagccccacatcaccagcaacagactggagtggatcgaccccgacagcagcatcaaggaccacatcaacgtggtgctgaacagagacgtgagcttccaggacctgagcgacaacccctacaaggtggacctgcacacccagagcatcgacggcgcctggggcagcggcgtgggcttcaccctggtgtgcatcgtgggcctgaccgagtgcgccaacttcatcaccagcatcaaggcctgcgacatggccatgtgctacggcgccaccgtgaccaacctgctgagaggcagcaacaccgtgaaggtggtgggcaagggcggccacagcggcagcctgttcaagtgctgccacgacaccgactgcaccgaggagggcctggccgccagccccccccacctggacagagtgaccggctacaaccagatcgacagcgacaaggtgtgcgacgacggcgcccccctgtgcagcgtgaagtgctggttcaccaagagcggcgagtggctgctgggcatcctgaacggcaactggatggtggtggccgtgctggtggtgatcctgatcctgagcatcctgctgttcagcttcttctgccccatcagaagcaagaagagcaagcccaactga

SEQ ID NO: 8607 - RNA, 3399 nt, synthetic construct
  misc_feature 1..3399: note = derived and/or modified CDS sequence (opt4) from THAIV(Thai749)__L08756.1__GP
  source 1..3399: mol_type = other RNA
atgtggggcctgctggtgatcgccgtgctggtgggccccggcttcgccatcaagaacgtgtacgacatgaagatcgagtgcccccacagcgtgaacttcggcgagaccagcgtgaccggccaggtggagctgcccgccctgcccatcaccgaggccgagcagctggtgcccgagagcagctgcaacatggacaaccaccagagcctggccaccatcaacaccctgaccaaggtgagctggagaaagaaggccgaccaggtgagcgccagccagaacagcttcgaggtgatcgaggccgagaccagcttcaagggcctgtgcatgctgaagcacagaatgatcgaggagagcttcaagaacagaagaagcgtgatctgctacgacctgagctgcaacaccaccttctgcaagcccaccgtgtacatggtggtgcccgtgcacgcctgcaacatgatgaagagctgcctggtgggcctgggcccctacagagtgcaggtggtgtacgagagaacctactgcaccgtgggcatcctgaccgagggcaagtgcttcatccccgacaagaccatcctgagcagcatcaagagaggcatgttcgtggtgaccagcgtgcaggtgctgtgcttcttcatcgtgcagaagggccacagctacaagatcatggacgaggtgaagaagagcatgatgaacaagtgcaacgacaccgagaacaaggtgcagggctactacatctgcatcctgggcggcaacagcgcccccgtgtacgtgcccagcctggacgacttcagaagcatggagatcttcagcaacatgctgagaagccccttcggcgaggaccacgacctgcccggcgaggagttcagcacctaccagatcgccggccccaccgaggccaaggtgccccacaccgccagcagcaagaacctggccctgatcgcctacagcggcaaccccagctacagcagcctgagcctgatcaccagcagccaggacggcagatacgtgttcagccccggcctgttccccaacctgaaccagacccagtgcgagaagaacgccctgcccatggtgtggagaggcatgatcgacctgagcggctactacgaggccatccacccctgcaacatcttctgcgtgctgagcggccccggcgccagctgcgaggccttcagcgagggcggcatcttcaacatcaccagccccacctgcctggtgagcaagcagaacagattcagagccgccgagcagcagatcaacttcgtgtgccagagagtggacatggacatcgtggtgtactgcaacggccagaagaagaccatcctgaccaagaccctgatcatcggccagtgcatctacaccatcaccagcctgttcagcctgctgcccggcgtggcccacagcatcgccatcgagctgtgcgtgcccggcttccacggctgggccaccgccgccctgctgatcaccttctgcttcggctggatcctgatccccaccatcaccctggccgtgctggtggtgctgaagttcatcgccaacatcctgcacaccaacagccaggagaacagattcaagctgatcctgaagaaggtgaaggaggagttcgagaagaccaagggcagcatggtgtgcgaggtgtgcaagtacgagtgcgagaccagcaaggagctgaaggcccacaacctgagctgcccccagagcaagtgcccctactgcttcacccactgcgagcccaccgaggccaccttcaaggcccactacaaggtgtgccaggccacccacagattcagagaggacctgaagaagaccgtgaccccccagaccgtgggccccggctgctacagaaccctgaacctgttcagatacaagagcagatgctacatcctgaccatgtggctgttcctgctgagcatcgagagcatcatgtgggccgccagcgccgccgagatccccctggtgcccctgtggaccgacaacgcccacggcatcggcagcgtgcccatgcacaccgacctggagctggacttcagcctgcccagcagcagcaagtacacctacaagagaaagctgaccaaccccgtgaacaccgagcagggcgtgcagctgcacatcgagatcgaggagcagggcatcggcgccgacgtgcaccacctgggccactggttcgacgccagactgaacctgaagaccagcttccactgctacggcgcctgcagcaagtaccagtacccctggcacaccgccaagtgccacttcgagaaggactacgagtacgagaacagctgggcctgcaaccccgccgactgccccggcgtgggcaccggctgcaccgcctgcggcctgtacctggaccagatgaagcccatcggcaccgcctacaagctggtggccatcagatacagcagaaaggcctgcgtgcagttcggcgaggagcacctgtgcaagaccatcgacatgaacgactgcttcgtgaccagacacgtgaagatctgcatcatcggcaccgtgagcaagttcatccagggcgacaccctgctgttcctgggccccctggagggcggcggcctgatcttcaagcactggtgcaccagcacctgccagttcggcgaccccggcgacatcatgagccccaaggacaagcccttcctgtgccccgagttccccggccagttcagaaagaagtgcaacttcgccaccacccccgtgtgcgagtacgacggcaaccagatcagcggctacaagaagatgaaggccaccatcgacagcttccagagcttcaacaccagcagcatccacttcaccgacgagagactgatggaggaccccgacggcatgctgagagaccacatcaacatcgtggtgaccaaggacatcgacttcgagaacctggccgagaacctgtgcggcatcggcctgcaggtgagcgccatcaagggcgcctggggcagcggcgtgggcttcaccctgacctgccaggtgagcctgaccgagtgccccaccttcctgaccagcatcaaggcctgcgacatggccatctgctacggcgccgagagcgtgaccctggtgagaggccagaacaccgtgaagatcagcggcaagggcggccacagcggcagcagcttcaagtgctgccacggcgtggactgcagcagcaacggcctgcaggccaaccccccccacctggacagagtggccggcgtgagcgagctgaccaacgagaaggtgtacgacgacggcgccccccagtgcggcatcgcctgctggttcatcaagagcggcgagtgggtgaagggcatcttcagcggcaactggatcgtgctgatcgtgctgtgcgtgctgctgctgatcagcctgatcctgctgggcatcttctgccccgtgagaaagcacaagaagagctga

SEQ ID NO: 8608 - RNA, 3426 nt, synthetic construct
  misc_feature 1..3426: note = derived and/or modified CDS sequence (opt4) from TULV(Moravia/5302v/95)__NC_005228.1__GP
  source 1..3426: mol_type = other RNA
atgttctgcctgtgcctgagcctgctgggcctgctgctgtgctggcccgccgccaccagaaacctgctggagctgaaggtggagtgcccccacaccatcggcctgggccagggcatcgtgatcggcagcgccgagctgccccccgtgcccctggccaaggtggagagcctgaagctggagagcagctgcaacttcgacctgcacaccagcaccgccgcccagcaggccttcaccaagtggagctgggagaagaaggccgacaccgccgagaacgccaaggccgccagcaccaccttccagagcagcagcaaggaggtgcagctgagaggcctgtgcgtgatccccaccctggtgctggagaccgccagcagaaccagaaagaccgtgacctgcttcgacctgagctgcaaccagaccgtgtgccagcccaccgtgtacctgatggcccccatccagacctgcgtgaccaccaagagctgcctgctgggcctgggcgaccagagaatccaggtggtgtacgagaagacctactgcgtgagcggccagctgatcgagggcaactgcttcaaccccctgcacaccatcgccatcagccagcccacccacacctacgacatcatgaccctggccgtgcactgcttcttcatcagcaagaagggcggcaccgacgacaccctgaagatcgagaagcagttcgagaccctggtggagaagaccggctgcaccgagaacgccctgaagggctactacgcctgcatcctgggcaccagcagcgaggtggtgtacgtgcccgccatggacgactacagaagcagcgagatcctgagcagaatgaccaccgccccccacggcgaggaccacgacatcgaccccaacgccatcagcagcctgagaatcgtgggccagctgaccggcaaggcccccagcaccgagagcagcgacaccgtgcagggcatcgccttcgccggcacccccctgtacaccagcaccagcatcctggtgagaaaggaggaccccatctacctgtggagccccggcatcatccccgagggcaaccacagccagtgcgacaagaagaccctgcccctgacctggaccggcttcatcaccctgcccggcgagatcgagaagaccacccagtgcaccgtgttctgcaccctgagcggccccggcgccgactgcgaggcctacagcgacaccggcatcttcaacatcagcagccccacctgcctggtgaacagagtgcagagattcagaggcgccgagcagcaggtgaagttcgtgtgccagagagtggacctggacatcaccgtgtactgcaacggcgtgaagaaggtgatcctgaccaagaccctggtgatcggccagtgcatctacaccttcaccagcatcttcagcctgatgcccggcgtggcccacagcctggccgtggagctgtgcgtgcccggcctgcacggctgggccaccatcagcctgctgatcaccttctgcttcggctggctggccatccccctgctgagcatgatcatcatcagattcctgctgatcttcacctacctgtgcagcaagtacagcaccgacagcaagttcaagctgatcatcgagaaggtgaagcaggagtaccagaagaccatgggcagcatggtgtgcgaggtgtgccagcagggctgcgagaccgccaaggagctggagagccacaagaagagctgcccccacggccagtgcccctactgcctgaaccccaccgaggccaccgagagcgccctgcaggcccacttcaaggtgtgcaagctgaccaccagattccaggagaacctgaagaagagcctgagcacctacgagcccaagagaggcctgtacagaaccctgagcatgttcagatacaagagcaagtgctacgtgggcctggtgtggtgcatcctgctgaccatggagctgatcgtgtgggccgccagcgccgagaccatcaacctggagcccggctggaccgacaccgcccacggcagcggcatcatccccctgaagaccgacctggagctggacttcagcctgcccagcagcgccacctacacctacagaagagagctgcagaaccccgccaacgagcaggagaagatccccttccacttccagatggagagacaggtgatccacgccgagatccagcacctgggccactggatggacggcaccttcaacctgaagaccgccttccactgctacggcagctgcatcaagtacgcctacccctggcagaccgccaagtgcttcctggagaaggacttcgagttcgagaccggctggggctgcaacccccccgactgccccggcgtgggcaccggctgcaccgcctgcggcgtgtacctggacaagctgagaagcgtgggcaaggtgtacaagatcctgagcctgaagtacaccagaaaggtgtgcatccagctgggcaccgagcagacctgcaagaccatcgacagcaacgactgcctggtgaccaccagcgtgaaggtgtgcatgatcggcaccatcagcaagttccagcccggcgacaccctgctgttcctgggccccctggaggagggcggcatgatcttcaagcagtggtgcaccaccacctgccagttcggcgaccccggcgacatcatgagcacccccctgggcatgaagtgccccgagcacgccggcagcttcagaaagaagtgcagcttcgccaccctgcccagctgccagtacgacggcaacaccgtgagcggctaccagagaatgatcgccaccaaggacagcttccagagcttcaacatcaccgagccccacatcaccaccaacagcctggagtgggtggaccccgacagcagcctgaaggaccacgtgaacctgatcgtgaacagagacctgagcttccaggacctggccgagaacccctgccaggtggacctgagcgtgagcagcatcgacggcgcctggggcagcggcgtgggcttcaacctggtgtgcagcgtgagcctgaccgagtgcgccagcttcctgaccagcatcaaggcctgcgacagcgccatgtgctacggcagcagcaccgccaacctggtgagaggccagaacaccgtgcacgtggtgggcaagggcggccacagcggcagcaagttcatgtgctgccacgacaagaagtgcagcgccaccggcctggtggccgccgccccccacctggacagagtgaccggctacaaccagatcgacaccaacaaggtgttcgacgacggcgccccccagtgcggcgtgcactgctggttcaagaagagcggcgagtggctgctgggcatcctgagcggcaactggatggtggtggccgtgctgatcgccctgttcatcttcagcctgctgctgttcagcctgtgctgccccagaagacagaactacaagaagaacaagtga

SEQ ID NO: 8609 - RNA, 5055 nt, synthetic construct
  misc_feature 1..5055: note = derived and/or modified CDS sequence (opt4) from CCHFV(10200)__U39455.2__GP
  source 1..5055: mol_type = other RNA
atgcacatcagcctgatgtacgccatcctgtgcctgcagctgtgcggcctgggcgagacccacggcagccacaacgagaccagacacaacaagaccgacaccatgaccacccacggcgacaaccccagcagcgagccccccgtgagcaccgccctgagcatcaccctggaccccagcaccgtgacccccaccacccccgccagcggcctggagggcagcggcgaggtgtacaccagcccccccatcaccaccggcagcctgcccctgagcgagaccacccccgagctgcccgtgaccaccggcaccgacaccctgagcgccggcgacgtggaccccagcacccagaccgccggcggcaccagcgcccccaccgtgagaaccagcctgcccaacagccccagcacccccagcaccccccaggacacccaccaccccgtgagaaacctgctgagcgtgaccagccccggccccgacgagaccagcacccccagcggcaccggcaaggagagcagcgccaccagcagcccccaccccgtgagcaacagaccccccaccccccccgccaccgcccagggccccaccgagaacgacagccacaacgccaccgagcaccccgagagcctgacccagagcgccacccccggcctgatgaccagccccacccagatcgtgcacccccagagcgccacccccatcaccgtgcaggacacccaccccagccccaccaacagaagcaagagaaacctgaagatggagatcatcctgaccctgagccagggcctgaagaagtactacggcaagatcctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccccgccggcctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactacagcctggacatcgacggcgccgtgagactgccccacatctaccacgagggcgtgttcatccccggcacctacaagatcgtgatcgacaagaagaacaagctgaacgacagatgcaccctgttcaccgactgcgtgatcaagggcagagaggtgagaaagggccagagcgtgctgagacagtacaagaccgagatcagaatcggcaaggccagcaccggcttcagaagactgctgagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgagaagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctga

SEQ ID NO: 8610 - RNA, 5055 nt, synthetic construct
  misc_feature 1..5055: note = derived and/or modified CDS sequence (opt4) from CCHFV(IbAr10200)__AF467768.2__GP
  source 1..5055: mol_type = other RNA
atgcacatcagcctgatgtacgccatcctgtgcctgcagctgtgcggcctgggcgagacccacggcagccacaacgagaccagacacaacaagaccgacaccatgaccacccccggcgacaaccccagcagcgagccccccgtgagcaccgccctgagcatcaccctggaccccagcaccgtgacccccaccacccccgccagcggcctggagggcagcggcgaggtgtacaccagcccccccatcaccaccggcagcctgcccctgagcgagaccacccccgagctgcccgtgaccaccggcaccgacaccctgagcgccggcgacgtggaccccagcacccagaccgccggcggcaccagcgcccccaccgtgagaaccagcctgcccaacagccccagcacccccagcaccccccaggacacccaccaccccgtgagaaacctgctgagcgtgaccagccccggccccgacgagaccagcacccccagcggcaccggcaaggagagcagcgccaccagcagcccccaccccgtgagcaacagaccccccaccccccccgccaccgcccagggccccaccgagaacgacagccacaacgccaccgagcaccccgagagcctgacccagagcgccacccccggcctgatgaccagccccacccagatcgtgcacccccagagcgccacccccatcaccgtgcaggacacccaccccagccccaccaacagaagcaagagaaacctgaagatggagatcatcctgaccctgagccagggcctgaagaagtactacggcaagatcctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccccgccggcctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactacagcctggacatcgacggcgccgtgagactgccccacatctaccacgagggcgtgttcatccccggcacctacaagatcgtgatcgacaagaagaacaagctgaacgacagatgcaccctgttcaccgactgcgtgatcaagggcagagaggtgagaaagggccagagcgtgctgagacagtacaagaccgagatcagaatcggcaaggccagcaccggcagcagaagactgctgagcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgagaagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaagggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtgggcgagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacagaagaatcgccgagctgttcagcaccaagacccacatcggctga

SEQ ID NO: 8611 - RNA, 5067 nt, synthetic construct
  misc_feature 1..5067: note = derived and/or modified CDS sequence (opt4) from CCHFV(Turkey-Kelkit06)__GQ337054.1__GP
  source 1..5067: mol_type = other RNA
atgcccaccaacatcatgcacacccccctggtgtgcttcatcctgtacctgcagctgctgtgcctgggcggcgcccacggccagctgaacgccaccgagcacaacggcaccaacaacaccaccgcccccggcgccagccagagccccaagccccccatgagcaccacccccccccacgcccccgagagcagcaccatcaagcccaccacccccatcagcgaggccgagggcagcggcgagaccaccagcccccccaacaccacccagggcctgagcagccccgagaccaccagcgagagacccgccaccaccagcatcagcaccagcagcaccgacagcaccaaccccaccacccagatgaccgacaacacccccacccccaccgtgagcaccagccccagcagcagccccagcacccccagcaccccccagggcatccaccaccccgccagaagcctgctgagcgtgagcagccccaagaccgtgaccacccccacccccaccagccccggcgagatgagcagcgagaccagcagccagcacagcgccatgagcagaatccccaccccccacaccgccaccagagtgagcaccgagatcaccaaccacagaacccccagacagagcgagagcagcgcccagcagaccacccccagccccatgaccagccccgcccagagcatcctgctgatgagcgccgcccccaccgccgtgcaggacatccaccccagccccaccaacagaagcaagagaaacctggagaccgagatcatcctgaccctgagccagggcctgaagaagtactacggcaagatcctgaagctgctgcacctgaccctggagcaggacaccgagggcctgctggagtggtgcaagggcaacctgggcagcaactgcgacgacgacttcttccagaagagaatcgaggagttcttcatgaccggcgagtgctacttcaacgaggtgctgcagttcaagaccctgagcaccctgagccccaccgagcccagccacgccagactgcccaccgccgagcccttcaagagctacttcgccaagggcttcctgagcatcgacagcggctacttcagcgccaagtgctaccccagaagcagcgccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcttcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcagaatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagatctaccagaccagagagggcttcgccagcatctgcctgttcatgctgggcagcatcctgttcatcgtgagctgcctggtgaagggcctggtggacagcgtgagcgagagcttcttccccggcctgagcgtgtgcaagacctgcagcatcggcagcgtgaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggtgcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggagccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggccctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcggcatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggctga

SEQ ID NO: 8612 - RNA, 5103 nt, synthetic construct
  misc_feature 1..5103: note = derived and/or modified CDS sequence (opt4) from CCHFV(UCCR4416)__KY484026.1__GP
  source 1..5103: mol_type = other RNA
atgttcctgcacttcaagttcatgctgctgaccaacttcttcttctgccagctgctgtggggcggcggcggcgtggccagcggcggcagaaccaacaccagcagcacccagaccaccctgatcagcagcaacaccctgaacagcaccatgagcgtgctggagagcagcatcggcaccgccaccgagaccgtgcccagcaccaccaccaacacccccgacacccaggtgaccaccgacagcggcagcggcgagagcagcaccgacccccagaccaccagcaaggaggtgcccagcaccagcgtggccaccatcaagacccaggagagcgagacccacagagcccagaaccccagcaccaccgccggcagcggcgccagcacccccagcaacaccaccagcaacaagcccgacgtgaacagcctgaccagccccatcctggaggccaagagcagccccagccccagcaagaccagcatgccccagaccgcccaccacctgagcagaagcctgctgagcgccgccaccaccgagaccaaccaggccgccagcgtgatgaccaccaccagagagaccaccaccatgagcagccccaccaccgtgaagaacagcgtgaccgccatccccacccagggcatcaccaccagcaacaccagcaagcagaccgacaccatcaccctggagatcagccccaagatccagaccacccagagccagcagaccgccacccccgccatcgcccccgccaccaccgccatcgccttcatcagccccaccaacagaagcaagagagagagcaaggtgcagatcatcctgaccttcagccagggcctgaagaagtactacagcaagatcctgaagctgctgcacctgacccaggaggaggacagcgagggcctgctggagtggtgcaccagagtgctggagcaggcctgcaacgacgactacttcaacgagagaatcgaggagttcttcatcaccggcaagggctacttcaacgacgtgctgcagttcagactgtacgacaccctgagcaccaccgagagcacccagaacaccagccccaccgccaagcccttcagaagctactacgccaagggcagcctgaccttcgacagcggctacttcagcgccaagtgctaccccagagccagcaacagcggcctgcagctgatcaacgtgacccagcacagcgtgaagatcgccaacacccccggccccaagatcagcaaccccaagaccatcaactgcatcaacctgaaggtgagcaccgacaaggaccacagcaagctggagatcaacgtgctgctgccccaggtggccgtgaacctgagcaactgccacgtgctgatcgagagccacgtgtgcgactacagcctggacaccgacggcaccatcaagctgcccaagatcacccacaacggcgccttcatccccggcacctacaagatcgtgatcgacaagaagaacaagctgaacgacagatgcgccctgttcaccaactgcgtgatcaagggcagagaggtgagaagaggccagagcgccctgagacagtacagaaccgagatcagaatcggccagaccttcaccggcagcagaagactgctggccgagggcggcagcaacgactgcgtgagcagaacccagctggtgaagaccgaggtggccgagatccacgaggacagctacggcggccccggcgagaagatcaccatctgcaacggcagcaccatcgtggaccagagactgggcagcgagctgggctgctacaccatcaacagagtgagaacctacaagctgtgcgagaacagcgccaccgagaagagctgcgagatcgacagcgtgcccgtgaagtgcaagcagggcttctgcctgaagatcacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacatccccctgctgggcagaaccgccatctacgtgtgcagaatgagcaaccaccccaagaccaccatggccttcctgttctggttcagcttcggctacgtgatcacctgcgtggtgtgcaaggtgctgttctacctgctgatcgtgatcggcaccctgggcaagagactgaagcagtacagagagctgaagccccagacctgcatcgtgtgcgagagcatccccgtgaacgccatcgacgccgagatgcacgacctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaaagctgctgcaggtgagcgagagcaccggcgtggccctgaagagaagctgctggatgatcaccctgctgatcctgctgaccgtgagcatgagccccgtgcagagcgcccccgtgggccacaagagagccgtggaggtgtaccagatgagagagagctacaccggcatctgcctgttcgtgctgggcagcgtgctgttcgccgtgagctggctggtgaaggccctgatcgacagcatcggcaacagcttcttccccggcctgagcatctgcaagacctgcagcatcggcagcatcaacggcttcgagatcgagagccacaagtgctactgcagcctgttctgctgcccctactgcagagcctgcagcagcgacaagatcacccacagaatgcacctgaacgtgtgcaagaagagaaaggtgggcagcaacgtgatgctggccgtgtgcaagagaatgtgcttcaaggccaccatcgaggccagcaacagagccaccttcatcagaaacatcatcaacagcaccttcgtgatctgcatcctgatcctggtgatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccctgatgctgagaaagcccctgttcctggacagaatcgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacaagggcaacaagatcctggtgagcggcagaagcgagagcatcatgaagctggaggagagaaccggcatcagctggtgcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgctggtgaagtggaaggtggagtacatcaagaccgaggccatcatctgcgtggagctgaccagccaggagagacagtgcagcctgatcgaggccggcaccagattcaacctgggccccgtgaccatcaccctgagcgagcccagaaacgtgcagcagagactgccccccgagatcatcaccctgcaccccaagatcgaggagggcttcttcgacctgatgcacgtgcagaaggtgatgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacctgaacaccagctggatgagctgggacggctgcgacctggactacttctgcaacatgggcgactggcccagctgcacctacaccggcgtgacccagcacaaccacgccgccttcatcaacatgctgaacatcgagaccgactacaccaagaccttccacttccacagcaagagagtgaccgcccacggcgacaccccccagctggacctgaaggccagacccgcctacggcgccggcgagatcaccgtgctggtggaggtggccgacctggagctgcacaccaagaagatcgaggtgagcggcctgaagttcgccagcctgagctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagagcggcgccgacagcaccttcaaggccttcagcagcatgcccaagaacagcctgtgcttctacatcgtggagagagactactgcagcagctgcaccgacgacgacacccagaagtgcgtggacatcaagctggagcacccccagagcatcctgatcgagcacaagggcaccatcatcggcaagcagaacgacacctgccccaccaagaccagctgctggctggagagcatcaagagcttcttctacggcctgaagaacatgctgagcggcatcttcggcaacgtgttcctgggcatgctgctgttcctggcccccttcatcctgctgatcctgttcttcttcttcggctggagactgctgttctgcctgaagtgctgcagaagaaccagaaagctgctgaagtacaagcacctgagagacgaggaggagagcggctacaagaagatcatcgagagactgaacgacaagaagggcaagagcagactgttcgacggcgagagactggccgacagaaagatcgccgagctgttcagcaccaagacccacatcggctga

SEQ ID NO: 8613 - RNA, 5103 nt, synthetic construct
  misc_feature 1..5103: note = derived and/or modified CDS sequence (opt4) from CCHFV(ArD15786)__DQ211627.1__GP
  source 1..5103: mol_type = other RNA
atgttcctgcacttcaagttcgtgctgctgaccaacttcttcttctgccagctgctgtggggcggcggcggcgtgaccagcggcggcggcaccaacaccagcagcacccaggccatcctgatcagcagcaacacccccaacagcaccatgagcgtgctggagagcagcaccggcaccgccgccgagaccgtgcccagcaccaccatcaacacccccgacacccaggtgaccaccgacagcggcagcggcgagagcagcaccgacccccagaccaccaacggcgaggtgcccagcaccagcatcgccaccatcaagacccaggagagcgagaccagaagaacccagaacctgagcaccaccgccggcagcggcgccagcacccccggcaacaccaccagcaacaagcccgacgtgaacctgctgaccagccccatcagcgaggccaagagcagccccagccccagcaagaccagcaccccccagaccgcccaccacctgagcagaagcctgctgagcgccgccaccaccgagaccagccaggccgccagcgtgatgaccaccaccagagagaccaccaccatgagcagccccaccaccgtgaagaacagcgccaccgccacccccacccagggcatcaccaccagcaacaccagcaagcagaccgacaccaccaccctggagatcccccccaagatccagaccacccagagccagcagaccgccacccccgccatcacccccgccaccaccgccatcgccttcatcagccccaccaacagaagcaagagagagagcaaggtgcagatcatcctgaccttcagccagggcctgaagaagtactacagcaagatcctgaagctgctgcacctgacccaggaggaggacagcgagggcctgctggagtggtgcaccagagtgctggagcaggcctgcgacgacgactacttcaacgagagaatcgaggagttcttcatcaccggcaagggctacttcaacgacgtgctgcagttcagactgtacgacaccttcagcaccaccgagagcacccagaacaccagccccaccgccaagcccttcagaagctactacgccaagggcagcctgaccttcgacagcggctacttcagcgccaagtgctaccccagagccagcaacagcggcctgcagctgatcaacgtgacccagcacagcgtgaagatcgccaacacccccggccccaagatcagcaaccccaagaccatcaactgcatcaacctgaaggtgagcaccgacaaggaccacagcaagctggagatcaacgtgctgctgccccaggtggccgtgaacctgagcaactgccacgtgctgatcgagagccacgtgtgcgactacagcctgaacaccgacggcaccatcaagctgcccaagatcgcccacaacggcgccttcatccccggcacctacaagatcgtgatcgacaagaagaacaagctgaacgacagatgcgccctgttcaccaactgcgtgatcaagggcagagaggtgagaagaggccagagcgccctgagacagtacagaaccgagatcagaatcggccagaccttcaccggcagcagaagactgctggccgagggcggcagcaacgactgcgtgagcagaacccagctggtgaagaccgaggtgaccgagatccacgaggacagctacggcggccccggcgagaagatcaccatctgcaacggcagcaccatcgtggaccagagactgggcagcgagctgggctgctacaccatcaacagagtgagaacctacaagctgtgcgagaacagcgccaccgagaagagctgcgagatcgacagcgtgcccgtgaagtgcaagcagggcttctgcctgaagatcacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacatccccctgctgggccagaccgccatctacgtgtgcagaatgagcaaccaccccaagaccaccatggccttcctgttctggttcagcttcggctacgtgatcacctgcgtggtgtgcaaggtgctgttctacctgctgatcgtgatcggcaccctgggcaagagactgaagcagtacagagagctgaagccccagacctgcatcgtgtgcgagagcatccccgtgaacgccatcgacgccgagatgcacgacctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaaagctgctgcaggtgagcgagagcaccggcgtggccctgaagagaagctgctggatcatcaccctgctgatcctgctgaccgtgagcatgagccccgtgcagagcgcccccgtgggccacaagagagccgtggaggtgtaccagatcagagagagctacaccggcatctgcctgttcgtgctgggcggcgtgctgttcgccgtgagctggctggtgaaggccctgatcgacagcatcggcaacagcttcttccccggcctgagcatctgcaagacctgcagcatcggcagcatcaacggcttcgagatcgagagccacaagtgctactgcagcctgctgtgctgcccctactgcagagcctgcagcagcgacaagatcacccacagaatgcacctgaacgtgtgcaagaagagaaaggtgggcagcaacgtgatgctggccgtgtgcaagagaatgtgcttcaaggccaccatcgaggccaacaacagagccaccttcatcagaaacatcatcaacagcaccttcgtgatctgcatcctgatcctggtgatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccctgatgctgagaaagcccctgagcctggacagcatcgccaagggcatgaagagcctgctgaacagcaccagcctggagaccagcctgagcatcgaggccccctggggcgccatcaacgtgcagagcaccttcaagcccaccatcagcgccgccaacatcgccctgagctggagcagcgtggagcacaagggcaacaagatcctggtgagcggcagaagcgagagcatcatgaagctggaggagagaaccggcatcagctggtgcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgctggtgaagtggaaggtggagtacatcaagaccgaggccatcatctgcgtggagctgaccagccaggagagacagtgcagcctgatcgaggccggcaccagattcaacctgggccccgtgaccatcaccctgagcgagcccagaaacgtgcagcagagactgccccccgagatcatcaccctgcaccccaagatcgaggagggcttcttcgacctgatgcacgtgcagaaggtgatgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacctgaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagagcggcgccgacagcaccttcaaggccttcagcagcatgcccaagaacagcctgtgcttctacatcgtggagagagactactgcagcagctgcaccgacgacgacacccagaagtgcgtggacatcaagctggagcacccccagagcatcctgatcgagcacaagggcaccatcatcggcaagcagaacgacacctgccccaccaagaccagctgctggctggagagcatcaagagcttcttctacggcctgaagaacatgctgagcggcatcttcggcaacatcttcctgggcatgctgctgttcctggcccccttcgtgctgctgatcctgttcttcttcttcggctggagactgctgttctgcctgaagtgctgcagaagaaccagaaagctgctgaagtacaagcacctgagagacgaggaggagagcggctacaagaagatcatcgagagactgaacgacaagaagggcaagagcagactgttcgacggcgagagactggccgacagaaagatcgccgagctgttcagcaccaagacccacgtgggctga

SEQ ID NO: 8614 - RNA, 5100 nt, synthetic construct
  misc_feature 1..5100: note = derived and/or modified CDS sequence (opt4) from CCHFV(UCCR4432)__KY484047.1__GP
  source 1..5100: mol_type = other RNA
atgttctgcctgagactggtgctgctgatcaacctggccctgtgccagctgctggagggcaacgacggcgtgaccagcgccgacgagatcaacagcaacaccacccagaccagcctgggcctgcccaccatcctgaacagcaccacccccgcccccggccccagcatcgacgccaccatggaggccgtgcccggcaccaccaacagcgtgctggagacccaggtgaccatggacagcggcagcggcgagctgagcaccgaccccaccaccaccagagaggccaccacccccatcaccgccgccaccgtgagcgcccaggagaccaagacccacatgacccagaaccccggcaccaccgtggaccccgacaccaccaccagcaacaccaccaccagcatcgagcccatcaccaccccccccaccagccccaccccccaggccacccccacccccagctacagcgagacccccaccctgcccaacacccaccacctgagcagaagcctgctgagcgccgtgggcaccgaggccggccagaccgcccccgccacccccaccgccgaggtggccctggcccccggcggcagcagcaccgccgagagcaacaccatcagcatccccgcccaggacaccaccatcagcggcgtgagcaagcaggacaaccccaccaccaccggcatcagccccgaggcccagaccatgcagagccagcaggccgtggcccccgtgaccacccccgccaccgccatcagcgcccccaccagccccaccaacagaagcaagagagagagcaaggtgcagatcatcctgaccttcccccagggcctgaagaagtactacagcaagatcctgaagttcctgcacctgacccaggaggaggacagcgagggcctgctggagtggtgcaccagagtgctgcagcaggtgtgcgacgacacctacttcaacgagagaatcaaggagttcttcatcaccggcaagggctacttcaacgacgtgctgcagttcaagctgcacgacacccccgccaccaccgtgcccgccctggccgccagcagcaccgccatgcccttcagaagctactacgccaagggcagcctgaccctggacagcggctacttcagcgccaagtgctaccccagagccagcaacagcggcatgcagctgatcaacgtgacccagcaccccatgaagatcgccaacacccccggccccaagatcagcaacctgaagaccatcaactgcatcaacctgaaggtgagcaccgacaaggagcacagcgagctggagatcaacgtgctgatcccccaggtggccgtgaacctgagcaactgcttcgtgagcatcaagagccacgtgtgcgactacagcctggacaccgacggcgccatcagactgcccaaggtggcccacaacggcgtgttcatgcccggcacctacaagatcgtgatcgacaagaagaacaagctgaacgacagatgcgccctgatcaccaactgcgtgatcaagggcagagaggtgagaaagggccagagcaccctgagacagtacaagaccgagatcagaatcggccagaccatcgccggcagcagaagactgctggccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcatcgtgtgcaaggtgctgttctacctgctgatcgtgatcggcaccctgagcaagaagctgaagcagtacagagagctgaagccccagacctgcatcgtgtgcgagagcacccccgtgaacgccatcgacgccgagatgcacgagctgaactgcaactacaacatctgcccctactgcgccagcagactgaccagcgacggcctggtgagacacgtgaaccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggccagggcaaggccgtggaggtgtacagagtgagagagagctacaccagcatctgcctgttcgtgctgggcagcgtgctgttcgccgtgagctggctgatcaagggcctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagatcacccacagaatgcacctgaacgtgtgcaagaagagaaaggccggcagcaacgtgatgctggccgtgtgcaagagaatgtgcttcaaggccaccgtggaggccagcaacaccgccctgctgatcagaggcatcatcaacagcaccttcgtgatctgcgtgctgatcctggtgatctgcgtggtgagcaccagcgccgtggacatggagaacctgcccgccggcatctgggagagagaggaggacctgaccaacttctgccaccaggagtgccaggtgaccgagaccgagtgcctgtgcccctacgaggccctgatcctgagaaagcccctgtacctggacagcatcgccaagggcatgaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccaggagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacatccagcagagactgcccagcgagatcgtgaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcagcgaccccgacgtggtggccgccggcagcagcctgatggccagaaagatcgagttcggcgccgacagcaccttcaaggccttcagcagcatgcccaagaacagcctgtgcttctacatcgtggagagagactactgcagcagctgcaccaacgacgacacccagaagtgcgtggacaccaagctggagcacccccagagcatcctgatcgagcacaagggcaccatcatcggcaagcagaacgacacctgcagcaccaagaccagctgctggctggagagcgtgaagagcttcttctacggcctgaagaacatgctgggcggcatcttcggcaacgtgttcctgggcatcttcctgttcctggcccccttcgccctgctgatcttcttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccgagctgttcagcaccaagacccacatcggctga

SEQ ID NO: 8615 - RNA, 5100 nt, synthetic construct
  misc_feature 1..5100: note = derived and/or modified CDS sequence (opt4) from CCHFV(Nakiwogo)__KX013484.1__GP
  source 1..5100: mol_type = other RNA
atgttctgcctgaagctggtgctgctgatcaacctgaccctgtgccagctgctggagggcaacgacagagtgaccagcgccgacggcatcaacagcaacaccacccagaccaacctgggcatcagcaccatcctgaacagcaccacccccgcccccggccccagcaccgacaccaccatggagaccgtgcccagcaccgccgacagcatgctggagacccaggtgaccaccgacagcggcagcggcgagcccagcaccgagcccaccaccaccggcgaggccaccagcagcaccaccgccgccaccgtgagcatgcaggagaccaagaagcacatgacccagaacaccagaagcaccgccgaccccgacaccaccacccccaacagcaccaccagcgtggagcccaccaccatcccccccaccagccccatcccccaggccacccccacccccggccacggcaaggcccccaccctgcccaacacccaccacctgagcagaagcctgctgagcgccgtgagcaccgaggccggccagaccacccccgccaccagcaccaccgaggccgccagcgcccccagcagcagcagcaccgccgagaacaacaccgtgagccagcccgcccaggacaccaccaccagcggcgtgagcgagcagtacaaccccaccaccaccggcatcagccccaaggcccagaccatgcagggccagcaggccatcgtgcccgtgaccacccccgtgaccaccaccttcacccccaccaaccccaccaacagaagcaagagagagagcaaggtgcagatcatcctgaccttcccccagggcctgaagaagtactacagcaagatcctgaagctgctgcacctgacccaggaggaggacagcgagggcctgctggagtggtgcaccagagtgctgcagcaggtgtgcgacgacacctacttcaacgagagaatcgaggagttcttcatcaccggcaagggctacttcaacgacgtgctgcagttcaagctgcacgacacccccaccaccaccgtgagcgccctggccgccagcagcaccgccatgcccttcagaagctactacgccaagggcagcctgaccctggacagcggctacttcagcgccaagtgctaccccagagccagcaacagcggcatgcagctgatcaacgtgacccagcaccccatgaagatcgccaacacccccggccccaagaccagcaacctgaagaccatgaactgcatcaacctgaaggtgagcaccgacaaggagcacagcgagctggagatcaacgtgctgatcccccaggtggccgtgaacctgagcaactgcctggtgagcatcaagagccacgtgtgcgactacagcctggacaccgacggcgccatcagactgcccaaggtggcctacaacggcgtgttcatgcccggcacctacaagatcgtgatcgacaagaagaacagactgaacgacagatgcgccctgatcaccaactgcgtgatcaagggcagagaggtgagaaagggccagagcaccctgagacagtacaagaccgagatcagaatcggccagaccctgatgggcagcagaagactgctggccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcgtggtgtgcaaggtgctgttctacctgctgatcgtgatcggcaccctgggcaagaagctgaagcagtacagagagctgaagccccagacctgcatcgtgtgcgagagcatccccgtgaacgtgatcgacgccgagatgcacgagctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggccaggagaaggccatcgaggtgtaccaggtgagagagagctacaccagcatgtgcctgttcgtgctgggcagcgtgctgttcgccgtgagctggctggtgaagggcctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagatcacccacagaatgcacctgaacatctgcaagagaagaaaggtgggcagcaacgtgatgctggccgtgtgcaagagaatgtgcttcaaggccaccgtggaggccagcaacagcgccctgctgatcagaagcatcatcaacagcaccttcgtgatctgcgtgctgatcctggtgatctgcgtggtgagcaccagcgccgtggacatggagaacctgcccgccggcatctgggagagagaggaggacctgaccaacttctgccaccaggagtgccaggtgaccgagaccgagtgcctgtgcccctacgaggccctgatcctgagaaagcccctgtacctggacagcatcgccaagggcatgaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacgtgcagcagagactgcccagcgagatcgtgaccctgcaccccaagatcgaggagggcttcttcgacctgatgcacgtgcagaaggtgctgttctgcaagcacagcctgcaggccaccagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcgtgaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagctgggcgccgacagcaccttcaaggccttcagcagcatgcccaagaacagcctgtgcttctacatcgtggagagagactactgcagcagctgcaccgacgacgacacccagaagtgcgtgaacaccaagctggagcacccccagagcatcctgatcgagcacaagggcaccatcatcggcaagcagaacgacacctgccccaccaagaccagctgctggctggagagcgtgaagagcttcttctacggcctgaagaacatgctgggcggcatcttcggcaacgtgttcctgggcatcttcctgttcctggcccccttcgccctgctgatcctgttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccgagctgttcagcaccaagacccacatcggctga

SEQ ID NO: 8616 - RNA, 5100 nt, synthetic construct
  misc_feature 1..5100: note = derived and/or modified CDS sequence (opt4) from CCHFV(UG3010)__AY900143.1__GP
  source 1..5100: mol_type = other RNA
atgttctgcctgagactggtgctgctgatcaacctggccctgtgccagctgctggagggcaacgacggcgtgaccagcgccgacgagatcaacagcaacaccacccagaccagcctgggcctgcccaccatcctgaacagcaccacccccgcccccggccccagcatcgacgccaccatggaggccgtgcccggcaccaccaacagcgtgctggagacccaggtgaccatggacagcggcagcggcgagctgagcaccgaccccaccaccaccagagaggccaccacccccatcaccgccgccaccgtgagcgcccaggagaccaagacccacatgacccagaaccccggcaccaccgtggaccccgacaccaccaccagcaacaccaccaccagcatcgagcccatcaccaccccccccaccagccccaccccccaggccacccccacccccagctacagcgagacccccaccctgcccaacacccaccacctgagcagaagcctgctgagcgccgtgggcaccgaggccggccagaccgcccccgccacccccaccgccgaggtggccctggcccccggcggcagcagcaccgccgagagcaacaccatcagcatccccgcccaggacaccaccatcagcggcgtgagcaagcaggacaaccccaccaccaccggcatcagccccgaggcccagaccatgcagagccagcaggccgtggcccccgtgaccacccccgccaccgccatcagcgcccccaccagccccaccaacagaagcaagagagagagcaaggtgcagatcatcctgaccttcccccagggcctgaagaagtactacagcaagatcctgaagttcctgcacctgacccaggaggaggacagcgagggcctgctggagtggtgcaccagagtgctgcagcaggtgtgcgacgacacctacttcaacgagagaatcaaggagttcttcatcaccggcaagggctacttcaacgacgtgctgcagttcaagctgcacgacacccccgccaccaccgtgcccgccctggccgccagcagcaccgccatccccttcagaagctactacgccaagggcagcctgaccctggacagcggctacttcagcgccaagtgctaccccagagccagcaacagcggcatgcagctgatcaacgtgacccagcaccccatgaagatcgccaacacccccggccccaagatcagcaacctgaagaccatcaactgcatcaacctgaaggtgagcaccgacaaggagcacagcgagctggagatcaacgtgctgatcccccaggtggccgtgaacctgagcaactgcttcgtgagcatcaagagccacgtgtgcgactacagcctggacaccgacggcgccatcagactgcccaaggtggcccacaacggcgtgttcatgcccggcacctacaagatcgtgatcgacaagaagaacaagctgaacgacagatgcgccctgatcaccaactgcgtgatcaagggcagagaggtgagaaagggccagagcaccctgagacagtacaagaccgagatcagaatcggccagaccatcgccggcagcagaagactgctggccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcatcgtgtgcaaggtgctgttctacctgctgatcgtgatcggcaccctgagcaagaagctgaagcagtacagagagctgaagccccagacctgcatcgtgtgcgagagcacccccgtgaacgccatcgacgccgagatgcacgagctgaactgcaactacaacatctgcccctactgcgccagcagactgaccagcgacggcctggtgagacacgtgaaccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggccagggcaaggccgtggaggtgtacagagtgagagagagctacaccagcatctgcctgttcgtgctgggcagcgtgctgttcgccgtgagctggctgatcaagggcctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagatcacccacagaatgcacctgaacgtgtgcaagaagagaaaggccggcagcaacgtgatgctggccgtgtgcaagagaatgtgcttcaaggccaccgtggaggccagcaacaccgccctgctgatcagaggcatcatcaacagcaccttcgtgatctgcgtgctgatcctggtgatctgcgtggtgagcaccagcgccgtggacatggagaacctgcccgccggcatctgggagagagaggaggacctgaccaacttctgccaccaggagtgccaggtgaccgagaccgagtgcctgtgcccctacgaggccctgatcctgagaaagcccctgtacctggacagcatcgccaagggcatgaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccaggagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacatccagcagagactgcccagcgagatcgtgaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcagcgaccccgacgtggtggccgccggcagcagcctgatggccagaaagatcgagttcggcgccgacagcaccttcaaggccttcagcagcatgcccaagaacagcctgtgcttctacatcgtggagagagactactgcagcagctgcaccaacgacgacacccagaagtgcgtggacaccaagctggagcacccccagagcatcctgatcgagcacaagggcaccatcatcggcaagcagaacgacacctgcagcaccaagaccagctgctggctggagagcgtgaagagcttcttctacggcctgaagaacatgctgggcggcatcttcggcaacgtgttcctgggcatcttcctgttcctggcccccttcgccctgctgatcttcttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccgagctgttcagcaccaagacccacatcggctga

SEQ ID NO: 8617 - RNA, 5100 nt, synthetic construct
  misc_feature 1..5100: note = derived and/or modified CDS sequence (opt4) from CCHFV(Semunya)__DQ094832.1__GP
  source 1..5100: mol_type = other RNA
atgttctgcctgaagctggtgctgctgatcaacctggccctgtgccagctgctggagggcaacgacagagtgaccagcgccgacggcatcaacagcaacaccacccagaccaacctgggcatcagcaccatcctgaacagcaccacccccgcccccggccccagcaccgacaccaccatggagaccgtgcccagcaccgccgacagcatgctggagacccaggtgaccaccgacagcggcagcggcgagcccagcaccgagcccaccaccaccggcgaggccaccagcagcaccaccgccgccaccgtgagcatgcaggagaccaagacccacatgacccagaacaccagaagcaccgccgaccccgacaccaccacccccaacaccaccaccagcgtggagcccaccaccatcccccccaccagccccatcctgcaggccacccccacccccggccacggcaaggcccccaccctgcccaacacccaccacctgagcagaagcctgctgagcgccgtgagcaccgaggccggccagaccacccccgccaccagcaccaccgaggccgccagcgcccccagcagcagcagcaccgccgagaacaacaccatgttccagcccgcccaggacaccaccaccagcggcgtgagcgagcagtacaaccccaccaccaccggcatcagccccaaggcccagaccatgcaggcccagcaggccatcgtgcccgtgaccacccccgtgaccaccaccttcacccccatcaaccccaccaacagaagcaagagagagagcaaggtgcagatcatcctgaccttcccccagggcctgaagaagtactacagcaagatcctgaagctgctgcacctgacccaggaggaggacagcgagggcctgctggagtggtgcaccagagtgctgcagcaggtgtgcgacgacacctacttcaacgagagaatcgaggagttcttcatcaccggcaagggctacttcaacgacgtgctgcagttcaagctgcacgacacccccaccaccaccgtgcccgccctggccgccagcagcaccgccatgcccttcagaagctactacgccaagggcagcctgaccctggacagcggctacttcagcgccaagtgctaccccagagccagcaacagcggcatgcagctgatcaacgtgacccagcaccccatgaagatcgccaacacccccggccccaagaccagcaacctgaagaccatgaactgcatcaacctgaaggtgagcaccgacaaggagcacagcgagctggagatcaacgtgctgatcccccaggtggccgtgaacctgagcaactgcctggtgagcatcaagagccacgtgtgcgactacagcctggacaccgacggcgccatcagactgcccaaggtggcctacaacggcgtgttcatgcccggcacctacaagatcgtgatcgacaagaagaacagactgaacgacagatgcgccctgatcaccaactgcgtgatcaagggcagagaggtgagaaagggccagagcaccctgagacagtacaagaccgagatcagaatcggccagaccctgatgggcagcagaagactgctggccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcgtggtgtgcaaggtgctgttctacctgctgatcgtgatcggcaccctgggcaagaagctgaagcagtacagagagctgaagccccagacctgcatcgtgtgcgagagcatccccgtgaacgccatcgacgccgagatgcacgagctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggccaggagaaggccatcgaggtgtaccaggtgagagagagctacaccagcatctgcctgttcgtgctgggcagcgtgctgttcgccgtgagctggctggtgaagggcctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagatcacccacagaatgcacctgaacatctgcaagagaagaaaggtgggcagcaacgtgatgctggccgtgtgcaagagaatgtgcttcaaggccaccgtggaggccagcaacagcgccctgctgatcagaagcatcatcaacagcaccttcgtgatctgcgtgctgatcctggtgatctgcgtggtgagcaccagcgccgtggacatggagaacctgcccgccggcatctgggagagagaggaggacctgaccaacttctgccaccaggagtgccaggtgaccgagaccgagtgcctgtgcccctacgaggccctgatcctgagaaagcccctgttcctggacagcatcgccaagggcaagaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacgtgcagcagagactgcccagcgagatcgtgaccctgcaccccaagatcgaggagggcttcttcgacctgatgcacgtgcagaaggtgctgttctgcaagtacagcctgcaggccaccagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcgtgaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagttcggcgccgacagcaccttcaaggccttcagcagcatgcccaagaacagcctgtgcttctacatcgtggagagagactactgcagcagctgcaccgacgacgacacccagaagtgcgtgaacatcaagctggagcacccccagagcatcctgatcgagcacaagggcaccatcatcggcaagcagaacgacacctgccccaccaagaccagctgctggctggagagcgtgaagagcttcttctacggcctgaagaacatgctgggcggcatcttcggcaacgtgttcctgggcatcttcctgttcctggcccccttcgccctgctgatcctgttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccaagctgttcagcaccaagacccacatcggctga

SEQ ID NO: 8618 - RNA, 5094 nt, synthetic construct
  misc_feature 1..5094: note = derived and/or modified CDS sequence (opt4) from CCHFV(79121)__AB069673.1__GP
  source 1..5094: mol_type = other RNA
atgctgttccacttcaagttcatgctgctgatcaacttcatcctgtgccacctgctgtggggcggcggcggcgtgaccggcggcgtggagaccaacagcagcagcacccaggccatccagaccccccccgtgaccagcaacagcaccacccccggccccagcaccgacaccgccaccgagaccgccagcagcatgaccaccagcacccccgacacccaggtgaccaccgacaacggcagcggcgagcccagcaccgaccccctgaccaccaacgaggccaccccccccctgagcgtgaccaccgcccagaccaccgagaccaagaagcacaccaccctggaccccagcaccagcaccaaccccgacgccaccacccccagcatcaccatcctgagcgccagcaacaccagcctgcccatcagcagcgtgcacgccagccccagccccagcagcagcgaggagcccaccccccagaacgcccaccacctgagcagaagcctgctgagcgccgtgagcaccgagaccggccagatcgccagcgccgccaccgccgccaaggagatcaccaccaagaacagcccccccaccgccggcaacgacaccatggtgaccagcgcccccaacggcaacatcagaaacacccccgagcaggccaaccccaccgcccccgaggccagccccaagatccagaccacccagaaccagcagaccgtgacccccgaggccacccccatcaccaccatcaccgccctgaccgacctgaccaacagaagcaagagagacagcaaggtgcagaagatcctgaccttcagccagggcctgaagaagtactacagcaagatcctgaagctgctgcagctgacccaggaggaggacagcgagggcctgctggagtggtgcaccagagtgctggagcaggcctgcgacgacgactacttcaacaagagaatcgaggagttcttcatcaccggcaagggctacttcaacgacgtgctgcagttcagactgcacgacgccctgagcaacaccgagcccgcccagaccaccagccccaccgccgtgcccttcaagagctactacgccaagggcagcctgaccttcgacagcggctacttcagcgccagatgctaccccagagccagcaacagcggcctgcagctgatcaacgtgacccagcaccccgtgaagatcgccaacacccccggccccaagctgagcaacctgaagaccatcaactgcatcaacctgaaggtgagcaccgacaaggagcacagcgagctggaggtgaacgtgctgctgccccaggtggccgtgaacctgagcaactgccacgtgagcatcaagagccacgtgtgcgactacagcctggacaccgacggcgccatcaagctgcccagagtggcccacaacggcgtgttcatccccggcacctacaagatcgtgatcgacaagaagaacaacctgaacgacagatgcaccctgatcaccaactgcgtgatcaagggcagagaggtgagaaagggccagagcgccctgagacagtacaagaccgagatcagaatcggccagaccttcaccggcagcagaagactgctggccgagggcggcagcagcgactgcatcagcagaacccagctggtgaagaccgaggtggccgagatccacgaggacagctacggcggccccggcgagaagatcaccatctgcaacggcagcaccatcgtggaccagggcctgggcagcgagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggcaaggagagagccatcgagacctaccaggccagagagacctacaccggcatctgcctgttcgtgctgggcagcgtgctgttcgccgtgagctggctgaccaaggccctgatcgacggcatcggcaacagcttcagccccggcctgagcgtgtgcaagacctgcagcatcggcagcatcaacggcttcgagatcgagagccacaagtgctactgcagcctgttctgctgcccctactgcagagcctgcagcagcgacaagaacacccacagaatgcacctgaacgtgtgcaagaagagaaagatgggcagcaacgtgatgctggccgtgtgcaagagaatgtgcttcagagccaccatcgaggccagcaacaaggccctgctgatcagaagcatcatcaacagcaccttcgtgatctgcatcctgatcctgaccatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccatggtgctgagaaagcccctgttcctggacagcaccgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccagatctaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaacctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcttcctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggctga

SEQ ID NO: 8619 - RNA, 5094 nt, synthetic construct
  misc_feature 1..5094: note = derived and/or modified CDS sequence (opt4) from CCHFV(7001)__AB069670.1__GP
  source 1..5094: mol_type = other RNA
atgctgttccacttcaagttcatgctgctgatcaacttcatcctgtgccacctgctgtggggcggcggcggcgtgaccggcggcgtggagaccaacagcagcagcacccaggccatccagaccccccccgtgaccagcaacagcaccacccccggccccagcaccgacaccgccaccgagaccgccagcagcatgaccaccagcacccccgacacccaggtgaccaccgacaacggcagcggcgagcccagcaccgaccccctgaccaccaacgaggccaccccccccctgagcgtgaccaccgcccagaccaccgagaccaagaagcacaccaccctggaccccagcaccagcaccaaccccgacgccaccacccccagcatcaccatcctgagcgccagcaacaccagcctgcccatcagcagcgtgcacgccagccccagccccagcagcagcgaggagcccaccccccagaacgcccaccacctgagcagaagcctgctgagcgccgtgagcaccgagaccggccagatcgccagcgccgccaccgccgccaaggagatcaccaccaagaacagcccccccaccgccggcaacgacaccatggtgaccagcgcccccaacggcaacatcagaaacacccccgagcaggccaaccccaccgcccccgaggccagccccaagatccagaccacccagaaccagcagaccgtgacccccgaggccacccccatcaccaccatcaccgccctgaccgacctgaccaacagaagcaagagagacagcaaggtgcagatcatcctgaccttcagccagggcctgaagaagtactacagcaagatcctgaagctgctgcagctgacccaggaggaggacagcgagggcctgctggagtggtgcaccagagtgctggagcaggcctgcgacgacgactacttcaacaagagaatcgaggagttcttcatcaccggcaagggctacttcaacgacgtgctgcagttcagactgcacgacgccctgagcaacaccgagcccgcccagaccaccagccccaccgccgtgcccttcaagagctactacgccaagggcagcctgaccttcgacagcggctacttcagcgccagatgctaccccagagccagcaacagcggcctgcagctgatcaacgtgacccagcaccccgtgaagatcgccaacacccccggccccaagctgagcaacctgaagaccatcaactgcatcaacctgaaggtgagcaccgacaaggagcacagcgagctggaggtgaacgtgctgctgccccaggtggccgtgaacctgagcaactgccacgtgagcatcaagagccacgtgtgcgactacagcctggacaccgacggcgccatcaagctgcccagagtggcccacaacggcgtgttcatccccggcacctacaagatcgtgatcgacaagaagaacaacctgaacgacagatgcaccctgatcaccaactgcgtgatcaagggcagagaggtgagaaagggccagagcgccctgagacagtacaagaccgagatcagaatcggccagaccttcaccggcagcagaagactgctggccgagggcggcagcagcgactgcatcagcagaacccagctggtgaagaccgaggtggccgagatccacgaggacagctacggcggccccggcgagaagatcaccatctgcaacggcagcaccatcgtggaccagagactgggcagcgagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggcaaggagagagccatcgagacctaccaggccagagagacctacaccggcatctgcctgttcgtgctgggcagcgtgctgttcgccgtgagctggctgaccaaggccctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagaacacccacagaatgcacctgaacgtgtgcaagaagagaaagatgggcagcaacgtgatgctggccgtgtgcaagagaatgtgcttcagagccaccatcgaggccagcaacaaggccctgctgatcagaagcatcatcaacagcaccttcgtgatctgcatcctgatcctgaccatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccatggtgctgagaaagcccctgttcctggacaacatcgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccaggtgtaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcttcctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggctga

SEQ ID NO: 8620 - RNA, 5094 nt, synthetic construct
  misc_feature 1..5094: note = derived and/or modified CDS sequence (opt4) from CCHFV(YL16070)__KY354081.1__GP
  source 1..5094: mol_type = other RNA
atgctgttccacttcaagttcatgctgctgatcaacttcatcctgtgccacctgctgtggggcggcgtgggcgtgaccggcggcgtggagaccaacagcagcagcacccaggccatccccaccccccccgtgaccagcaacagcaccacccccggccccagcaccgacaccgccaccgagaccgccagcagcatgaccaccagcacccccgacacccaggtgaccaccgacaacggcagcggcgagcccagcaccgaccccctgaccaccaacgaggccaccccccccctgagcgtgaccaccgcccagaccaaggagaccaagaagcacaccaccctggaccccaacaccagcgccaaccccgacgccaccacccccagcatcaccatcctgagcgccagcaacaccagcctgcccaccagcagcgtgcacgccagccccagccccagcagcagcgaggagcccaccccccagaacgcccaccacctgagcagaagcctgctgagcgccgtgagcaccgagaccggccagaccgccagcgccaccaccgccaccaaggagatcaccaccaagaacagcccccccaccgccggcaacgacaccatggtgaccagcgcccccaacggcaacaccagaaacacccccgagcaggccaaccccaccgcccccgaggccagcctgaagatccagaccacccagaaccagcagaccgtgacccccgaggccacccccatcaccaccgtgaccgccctgaccgacctgaccaacagaagcaagagagacagcaaggtgcagatcatcctgaccttcagccagggcctgaagaagtactacagcaagatcctgaagctgctgcagctgacccaggaggaggacagcgagggcctgctggagtggtgcaccagagtgctggagcaggcctgcgacgacgactacttcaacaagagaatcgaggagttcttcatcaccggcaagggctacttcaacgacgtgctgcagttcagactgcacgacgccctgagcaacaccgagcccgcccagaccaccagccccaccgccgtgcccttcaagagctactacgccaagggcagcctgaccttcgacagcggctacttcagcgccagatgctaccccagagccagcaacagcggcctgcagctgatcaacgtgacccagcaccccgtgaagatcgccaacacccccggccccaagctgagcaacctgaagaccatcaactgcatcaacctgaaggtgagcaccgacaaggagcacagcgagctggaggtgaacgtgctgctgccccaggtggccgtgaacctgagcaactgccacgtgagcatcaagagccacgtgtgcgactacagcctggacaccgacggcgccatcaagctgcccagagtggcccacaacggcgtgttcatccccggcacctacaagatcgtgatcgacaagaagaacaacctgaacgacagatgcaccctgaccaccaactgcgtgatcaagggcagagaggtgagaaagggccagagcgccctgagacagtacaagaccgagatcagaatcggccagaccgtgaccggcagcagaagactgctggccgagggcggcagcagcgactgcatcagcagaacccagctggtgaagaccgaggtggccgagatccacgaggacagctacggcggccccggcgagaagatcaccatctgcaacggcagcaccatcgtggaccagagactgggcagcgagctgggctgctacaccatcaacagagtgaagagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgtgtgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatgagccccgtgcagagcgcccccgtgggcaaggagagagccatcgagacctaccaggccagagaggcctacaccggcatctgcctgttcgtgctgggcagcgtgctgttcgccgtgagctggctgaccaaggccctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagaacacccacagaatgcacctgaacgtgtgcaagaagagaaagatgggcagcaacgtgatgctggccgtgtgcaagagaatgtgcttcagagccaccatcgaggccagcaacaaggccctgctgatcagaagcatcatcaacagcaccttcgtgatctgcatcctgatcctgaccatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccatggtgctgagaaagcccctgttcctggacagcatcgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccaggtgtaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctgaagagcttcaagggcttcttctacggcctgaagaacatgctgagcggcatcttcggcaacgtgttcctgggcatcctgctgttcctggcccccttcgtgctgctgatcttcttcttcttcttcggctggagactgctgttctgcctgaagtgctgcaagaagaccaagggcctgctgaagtacaagcacctgaaggacaaggaggaggccggctacaagaagatcatcgagagactgaacggcaagaagggcaagagccagctgttcgacggcgagagactggccaacagaaagatcgccgagctgttcagcaccaagatccacatcggctga

SEQ ID NO: 8621 - RNA, 5094 nt, synthetic construct
  misc_feature 1..5094: note = derived and/or modified CDS sequence (opt4) from CCHFV(YL04057)__FJ562094.1__GP
  source 1..5094: mol_type = other RNA
atgctgttccacttcaagttcatgctgctgatcaacttcatcctgtgccacctgctgtggggcggcggcggcgtgaccggcggcgtggagaccaacagcagcagcacccaggccatccccaccccccccgtgaccagcaacagcaccacccccggccccagcaccgacaccgccaccgagaccgccagcagcatgaccaccagcacccccgacacccaggtgaccaccgacaacggcagcggcgagcccagcaccgacccccccaccaccaacgagaccacccccccccccagcgccaccaccgcccagaccaccgagaccaagaagcacaccaccctggaccccaacaccagcaccaaccccgacgccatcacccccagcatcaccatcctgagcgccagcaacaccagcctgcccatcagcagcgtgcacgccagccccagccccagcagcagcgaggagcccaccccccagaacgcccaccacctgagcagaagcctgctgagcgccgtgagcaccgagaccggccagatcgccagcgccaccaccgccgccaaggagatcaccaccaagaacagcccccccaccgccggcaacgacaccatgatcaccagcgcccccaacggcaacaccagaaacacccccgagcaggccaaccccaccgcccccgaggccagccccaagatccagaccacccagaaccagcagaccgtgatccccgaggccacccccatcaccaccatcaccgccctgaccgacctgaccaacagaagcaagagagacagcaaggtgcagatcatcctgaccttcagccagggcctgaagaagtactacagcaagatcctgaagctgctgcagctgacccaggaggaggacagcgagggcctgctggagtggtgcaccagagtgctggagcaggcctgcgacgacgactacttcaacaagagaatcgaggagttcttcatcaccggcaagggctacttcaacgacgtgctgcagttcagactgcacgacgccctgagcaacaccgagcccgcccagaccaccagccccaccgccgtgcccttcaagagctactacgccaagggcagcctgaccttcgacagcggctacttcagcgccagatgctaccccagagccagcaacagcggcctgcagctgatcaacgtgacccagcaccccgtgaagatcgccaacacccccggccccaagctgagcaacctgaagaccatcaactgcatcaacctgaaggtgagcaccgacaaggagcacagcgagctggaggtgaacgtgctgctgccccaggtggccgtgaacctgagcaactgccacgtgagcatcaagagccacgtgtgcgactacagcctggacaccgacggcgccatcaagctgcccagaatcgcccacaacggcgtgttcatccccggcacctacaagatcgtgatcgacaagaagaacaacctgaacgacagatgcaccctgaccaccaactgcgtgatcaagggcagagaggtgagaaagggccagagcgccctgagacagtacaagaccgagatcagaatcggccagaccttcaccggcagcagaagactgctggccgagggcggcagcagcgactgcatcagcagaacccagctggtgaagaccgaggtggccgagatccacgaggacagctacggcggccccggcgagaagatcaccatctgcaacggcagcaccatcgtggaccagagactgggcagagagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggcaaggagagagccatcgagacctaccaggccagagagacctacaccggcatctgcctgttcgtgctgggcagcgtgctgttcgccgtgagctggctgaccaaggccctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagaacacccacagaatgcacctgaacgtgtgcaagaagagaaagatgggcagcaacgtgatgctggccgtgtgcaagagaatgtgcttcagagccaccatcgaggccagcaacaaggccctgctgatcagaagcatcatcaacagcaccttcgtgatctgcatcctgatcctgaccatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccatggtgctgagaaagcccctgttcctggacagcatcgccaagggcaagaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcagccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccaggtgtaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcctgctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggctga

SEQ ID NO: 8622 - RNA, 5094 nt, synthetic construct
  misc_feature 1..5094: note = derived and/or modified CDS sequence (opt4) from CCHFV(79121M18)__GU477493.1__GP
  source 1..5094: mol_type = other RNA
atgctgttccacttcaagttcatgctgctgatcaacttcatcctgtgccacctgctgtggggcggcggcggcgtgaccggcggcgtggagaccaacagcagcagcacccaggccatccagaccccccccgtgaccagcaacagcaccacccccggccccagcaccgacaccgccaccgagaccgccagcagcatgaccaccagcacccccgacacccaggtgaccaccgacaacggcagcggcgagcccagcaccgaccccctgaccaccaacgaggccaccccccccctgagcgtgaccaccgcccagaccaccgagaccaagaagcacaccaccctggaccccagcaccagcaccaaccccgacgccaccacccccagcatcaccatcctgagcgccagcaacaccagcctgcccatcagcagcgtgcacgccagccccagccccagcagcagcgaggagcccaccccccagaacgcccaccacctgagcagaagcctgctgagcgccgtgagcaccgagaccggccagatcgccagcgccgccaccgccgccaaggagatcaccaccaagaacagcccccccaccgccggcaacgacaccatggtgaccagcgcccccaacggcaacatcagaaacacccccgagcaggccaaccccaccgcccccgaggccagccccaagatccagaccacccagaaccagcagaccgtgacccccgaggccacccccatcaccaccatcaccgccctgaccgacctgaccaacagaagcaagagagacagcaaggtgcagaagatcctgaccttcagccagggcctgaagaagtactacagcaagatcctgaagctgctgcagctgacccaggaggaggacagcgagggcctgctggagtggtgcaccagagtgctggagcaggcctgcgacgacgactacttcaacaagagaatcgaggagttcttcatcaccggcaagggctacttcaacgacgtgctgcagttcagactgcacgacgccctgagcaacaccgagcccgcccagaccaccagccccaccgccgtgcccttcaagagctactacgccaagggcagcctgaccttcgacagcggctacttcagcgccagatgctaccccagagccagcaacagcggcctgcagctgatcaacgtgacccagcaccccgtgaagatcgccaacacccccggccccaagctgagcaacctgaagaccatcaactgcatcaacctgaaggtgagcaccgacaaggagcacagcgagctggaggtgaacgtgctgctgccccaggtggccgtgaacctgagcaactgccacgtgagcatcaagagccacgtgtgcgactacagcctggacaccgacggcgccatcaagctgcccagagtggcccacaacggcgtgttcatccccggcacctacaagatcgtgatcgacaagaagaacaacctgaacgacagatgcaccctgatcaccaactgcgtgatcaagggcagagaggtgagaaagggccagagcgccctgagacagtacaagaccgagatcagaatcggccagaccttcaccggcagcagaagactgctggccgagggcggcagcagcgactgcatcagcagaacccagctggtgaagaccgaggtggccgagatccacgaggacagctacggcggccccggcgagaagatcaccatctgcaacggcagcaccatcgtggaccagggcctgggcagcgagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggcaaggagagagccatcgagacctaccaggccagagagacctacaccggcatctgcctgttcgtgctgggcagcgtgctgttcgccgtgagctggctgaccaaggccctgatcgacggcatcggcaacagcttcagccccggcctgagcgtgtgcaagacctgcagcatcggcagcatcaacggcttcgagatcgagagccacaagtgctactgcagcctgttctgctgcccctactgcagagcctgcagcagcgacaagaacacccacagaatgcacctgaacgtgtgcaagaagagaaagatgggcagcaacgtgatgctggccgtgtgcaagagaatgtgcttcagagccaccatcgaggccagcaacaaggccctgctgatcagaagcatcatcaacagcaccttcgtgatctgcatcctgatcctgaccatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccatggtgctgagaaagcccctgttcctggacagcaccgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccagatctaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcttcctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggctga

SEQ ID NO: 8623 - RNA, 5088 nt, synthetic construct
  misc_feature 1..5088: note = derived and/or modified CDS sequence (opt4) from CCHFV(ArD39554)__DQ211628.1__GP
  source 1..5088: mol_type = other RNA
atgctgtgccacatcaagcacatcctgctgttctgcatcatcctgtaccaccagcagtggaacaccggcgccagcaacaccaccatcagccccaccaccaacaagagccacaccgacatcagccaccagcccaccagcatcaccgccgccagcagccccggcagccccgccaccaccgccccccccgagagaagcgtgacccccagccacacccccaccaccagcgtgagcgaggccggcagcggcgagccccccgccgccacccccgccagcgccaccgcccagagccccgagcccgccagcgccgcccagcccagccccaccatccccaagcccaccacccccgaccccaccagcgaggccctgagcacccccgccaccagcagaccccaggagcccagcacccaccccagccccagaagcagccccagcaagcccgtggagacccagagcaccagacacaccgccagagagctgctgagcgtgaccggcaccgaggccgagcagctgatcacccagaccatccacaccaccaaggaggccaccaaggccaccagcccccagcccaccgccagcaaccccgaccccaccctggccaccaccagcagaagcatcaacagcatcaaccccaagggccccgagagcaccagagccaccccccagagcaccagccccacccccgagagcagcaccatccagacccagatcctgcccatcatcaccacccccggcaccctggaggccatcatccaccccaccaacagaagcaagagaaacctgggcaccgagatcatcctgaccctgccccagggcctgaagaagtactacagcaaggtgctgaagctgatgcacctgaccagagaggaggacagcgagggcctgctggagtggtgcaccagaatcctgggccagacctgcgacgacgactacttccagaagagaatcaccgagttcttcatcaccggcgtgggctacttcaacgaggtgctgctgttcaaggagaccaccgacgcccccaccctggcccccacccacaagggcgccccccccaccgagcccttcaagagctactacgccaagggcttcatcaccatggacagcggctacttcagcgccaagtgctacagcagagccagcaacagcggcctgcagctgatcaacgtgaccatgcacagcagcaagatgcccatcacccccggccccaagtacagcaacctgaagaacatcaactgcatcaacctgaaggtgagcaccgacaaggagcacaacgaggtggagatcaacgtgctgctgccccaggtggccgtgaacctgagcagctgccacgtgctggtgagaagccacgtgtgcgactacagcctggacgccgacggcatgatcaagctgccccagatcacccacgagggcaccttcatccccggcacctacaagatcatcatcgacaagaagaacaagcagaacgacagatgcaccctgatcaccaactgcgtgatcaagggcagagaggtgagaaagggccagagcgccctgagacagtacaagaccgagatcagagtgggccaggccagcagcggcaccagaagactgctgagcgagagcaacaacaacgactgcgtgagcagaacccagctgatcaagaccgagaacgccgagatccacggcgacgactacggcggccccggcgagaagatcaccatctgcaacggcagcaccatcgtggagcagagactgggcagcgagctgggctgctacaccatcaacagaatcaagagcttcaagctgtgcgagaacagcgccagcggcaagggctgcgagatcgacagcacccccgtgaagtgcaagcagggcttctgcctgaagatcacccaggagggcagaggccacgtgaagctgagcagaggcagcgagatcatcctggacgtgtgcgacagcagctgcgagatgatgatccccaagggcagcggcgacatcctggtggactgcagcggcggccagcagcacttcctgcaggacaacctggtggacctgggctgccccaacgtgcccctgctgggcaagatggccatctacatctgcagaatgagcaaccaccccaagaccaccatggccttcctgttctggttcagcttcggctacgtgatcacctgcatcttctgcaaggtgatcttctacgtgctgatcatcatcggcaccctgggcaagagaatcaagcagtacagagagctgaagccccagacctgcaccatctgcgaggccacccccgtgaacgccatcgacgccgagatgcacgacctgaactgcagctacaacatctgcccctactgcgccagcagactgaccagcgagggcctggtgagacacgtgacccagtgccccaagagaaaggagaagatcgaggagaccgagctgtacctgaacctggagagaatcccctggttcgtgagaaagctgctgcaggtgagcgagagcaccggcgtggccctgaagagaagcagctggctggtgaccctgctggtgctgctgaccgtgagcctgagccccgtgcagagcgcccccatcggccaggagagaaccgtggtgacctaccaggtgagagagagctacaccggcatgtgcctgttcatcctgggcagcgtgctgttcgccatcagctggctgaccaagggcctggtggacagcgtgggcaacatcttcttccccggcctgagcgtgtgcaagacctgcagcatcggcagcatcaacggcttcgagatcgagagccacaagtgctactgcagcctgttctgctgcccctactgcagatactgcagcgccgacagaggcgcccaccagagccacctgagcgtgtgcaagaagagaaagaccggcagcaacgtgatgctggccgtgtgcaagagaatgtgcttcagagccaccctgaaggtgagcagcgaggccctgatcatcagaagcatcatcaacaccaccttcgtggtgtgcatcctgatcctggtggtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccttcgtgctgagaaagcccctgttcctggacagcaccgccaagagcatgaagagcctgctgaacagcaccagcctggagaccagcctgagcatcgaggccccctggggcgccatcaacgtgcagagcaccttcaagcccaccgccagcaccgccaacatcgccctgagctggagcagcgtggagcacagaggcaacaagatcctggtgaccggcagaagcgagagcatcatgaagctggaggagagaaccggcatcagctggaacctgggcgtggaggacgccagcgagagcaagaccctgaccgtgagcgtgatggacctgagccagatgtacagcaccgtgttcgagtacctgagcggcgacagacaggtggaggagtggcccaaggccacctgcaccggcgactgccccgagagatgcggctgcaccagcagcacctgcctgcacaaggcctggccccacagcagaaactggagatgcaaccccacctggtgctggggcgtgggcaccggctgcacctgctgcggcctggacgtgaagaacctgttcaccgactacatgctgatcaagtggaaggtggagttcatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagctggtgaccctgcaccccagagtggaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaagatcaacggcaacagcttccacaagatcgagcccaacctgaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgagaccccccagctggacctgaaggccagacccaagtacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgagactgcacgtggacgagcccgacgagctgaccgtgcacgtgaagagcgacgaccccgacgtggtggccgccagcagcagcctgatggccagaaagatcgagttcggcaccgacagcaccttcaaggccttcagcagcatgcccaaggacaagctgtgcttctacatcgtggagagagactactgcagcagctgcagcaaggaggacacccagaagtgcgtgaacgccaagctggagcagccccagagcatcctgatcgagcacaagggcaccatcatcggcaagcagaacgacacctgcaccgtgaaggccagctgctggctggagagcgtgaagagcttcttctacggcctgaagaacatgctgggcggcatcttcggcaacgtgatcctgggcatcatcatgttcctggcccccttcgccctgctgctgctgttcttcctgttcggctggagaatcctgttctgcctgagatgctgcagaagaaccagaggcctgttcaagtacaagcacatcaaggacgacgaggagagcggctacaagagaatcatcgagagactgaacaacaagaagggcaagaacaagctgttcgacggcgagagactggccgacaagaagatcgccgagctgttcagcaccaagacccacatcggctga

SEQ ID NO: 8624 - RNA, 5088 nt, synthetic construct
  misc_feature 1..5088: note = derived and/or modified CDS sequence (opt4) from CCHFV(AP92)__DQ211625.1__GP
  source 1..5088: mol_type = other RNA
atgcccgaccacttcatcctgctgctgctgatgtacaccgtgttccaccagcacccccaggacgtgagcgccaacgtgcacctggtgaaccccagcaacagcaccaccggcgccagcaccgccttcaaccccgtgcacaacgccaccaccgacggccagaagcagagcaccagcaccaccaccatggccagacccagcaccgtgacccagatcaccaccgcccaggccatggaggtggacggcagcggcgagagcaccaccctgcccgccgtgacccccacccccgccgagaccaccacccacgccaaccagaagagcgccagcaccatgggcaccctgaccaccagcctggaggacaccgccctgatgaccctgaccggcagaagcatcctgaccagccagagccagaccggcagcttcgacagaaccagcaagccccagacccccagaagcaccaaccagcccctgagaaagctgctgagcgccgtgagcaccgaggccgccccccagaccagccccaccgccgtgaccgccgaccagaccgaggccagcaccagcccccaggtgaccaccgacaccagccccagcacccccacccaggtgaccagcagcgccggcagcagcagcagcaacaccagcaaccacagcaagaccaccccccagctgaccagcagcggcagcgaggcccagcagacccagcccaccaccatgcccaacaccaccgccctggtgacccccaccgcccacatcagccccaccaacagaagcaagagaaacagcgaggtggagatcatcctgaccctgccccagggcctgaagaagtactacagcaagatcctgaagctgctgcacctgaccctggaggaggacagcgagggcctgctggagtggtgcaccagaaccctgaagcaggcctgcgacgacggctacttccaggagagaatcaaggagttcttcctgaccggcgagggctacttcaacgaggtgctgctgttcagaagccccagccagctgggcaccaccggcagccccctggccagcccccccaccgccgagcccttcaagagcttctacgccaagggcttcctgatcatggacagcggctacttcagcgccaagtgctaccccaaggccagcaacagcggcctgcagctgatcaacatcacccagcacagcatcaaggtggtgaacacccccggccccaagtacagcaacctgaagaccgtgaactgcatcaacctgaaggtgagcaccgacaaggaccacagcgagctggaggtgaacgtgctgctgccccaggtggccgtgaacatcagcaactgccacgtgctgatcaagagccacgtgtgcgactacagcctggacaccgacggcatgatcagactgccccaggtgacccacgagggcaccttcatccccggcacctacaagatcgtgatcgacaagaagaacaagctgaacgacagatgcaccatgaccaccaactgcgtgatcaagggcaaggaggtgagaaagggccagagcaccctgagacagtacagaaccgagatcagagtgggccagatgagcagcggcaccagaagactgctgagcgagggcggcgacggcggctgcatcagcagaacccagctgatcaagaccgagaccgccgaggtgcacggcgacgactacggcggccccggcgagaagatcaccatctgcaacggcagcaccatcgtggaccagagactgggcagcgagctgggctgctacaccatcaacagaatcaagagcttcaagctgtgcgagaacagcgcccagggcaagaactgcgagatcgacagcgcccccgtgcagtgcagacagggctactgcctgaagatcagccaggagggcagaggccacgtgaagctgagcagaggcagcgagatcgtgctggacgtgtgcgacaccagctgcgagatcatgatccccaagggcaccggcgacatcctggtggactgcagcggcggccagcagcacttcctgcagagcaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaagaccctgttctacatcctgatcatcatcggcaccctgggcaagaagctgaagcagtacagagagctgaagccccagacctgcaccatctgcgagagcgtgcccgtgaacgccatcgacgccgagatgcacgacctgaactgcagctacaacatctgcccctactgcgccagcagactgaccagcgagggcctgaccagacacgtgaaccagtgccccaagagaaaggagaaggtggaggagaccgagctgtacctgaacctggagagaatcccctggatcgtgagaaagctgctgcaggtgagcgagagcaccggcgtggccctgaagagaagcagctggatgatcgtgctgctgatcctgctgatcgtgagcatgagccccgtgcagagcgcccccatcagccaggagagaaccgtggccctgtaccagagcagagaggactacatgggcatctgcctggtgatcatgggcagcgtgctgctggccgtgagcctgctggtgagaggcctgatcgacagcatcagcagcaccttcttccccggcctgagcgtgtgcagaacctgccacatcggcagcatcaacggcttcgagatcgagagccacaagtgctactgcggcctgctgtgctgcccctactgcagagcctgcagcaccgaccaggacgcccaccagttccacctgagcgtgtgcaagaagagaaaggccggcagcaacgtgatgctggccgtgtgcaagagaatgtgcttcaaggccatcatcgaggccagcaacaaggtgctgttcatcagaaacgtgatcaacaccaccttcgtggtgtgcatcctggtgatggtggcctgcatcgccagcagcgccgccgtggagatggagaacctgcccgccggcacctgggagagagaggaggagctgaccaacttctgccaccaggagtgccaggtgaccgagaccgagtgcctgtgcccctacgagagcttcatcctgagaaagcccctgttcctggacagcatcgccaagggcgtgaagaacctgctgaacagcaccagcctggagaccagcctgagcatcgaggccccctggggcgccatcaacgcccagagcacctacaagcccaccgccagcagcgccaacatcgccctgacctggagcagcgtggagcacagaggcaacaagatcctggtgagcggcagaagcgagagcatcatgaagctggaggagagaaccggcatcagctggaacctgggcgtggaggacgccagcgagagcagaaccctgaccatcagcgtgatggacctgagccagatgtacagccccgtgttcgagtacctgagcggcgacagacaggtggaggagtggcccaaggccacctgcaccggcaactgccccgagagatgcggctgcaccagcagcacctgcctgtacaaggagtggccccacagcagaaactggagatgcaaccccacctggtgctggggcgtgggcaccggctgcacctgctgcggcctggacgtgaaggagctgttcaccgaccacatgctggtgaagtggaaggtggagtacatcaagaccgaggccatcgtgtgcgtggagctgaccagccaggagagacagtgcagcctgatcgaggccggcaccagattcagcctgggccccgtgaccatcaccctgagcgagcccagaaacatccagcagaagctgccccccgagctgatcaccctgcaccccaagatcgaggacggctacttcgacctgatgcacgtgcagaaggtgatgagcgccagcaccgtgtgcaagctgcagagctgcacccacggcgtgcccggcgacctgcagatctaccacgtgggcaacctgctgaagggcgacagagtgaacggccacctgatccacaaggtggagccccacctgaacaccagctggatgagctgggacggctgcgacctggactacttctgcaacatgggcgactggcccagctgcacctacaccggcgtgacccagcacaaccacgccgccttcgccaacctgctgaacatcgagaccgactacaccaagaccttccacttccacagcaagagagtgaccgcccacggcgacaccccccagctggacctgaaggccagacccagatacggcgccggcgagatcaccgtgctggtggaggtggccgacatggagctgcacaccaagaaggtggaggtgaccggcctgaagttcgccagcctgacctgcagcggctgctacgcctgcagcagcggcatcagctgcaaggtgagaatccacgtggacgagcccgacgagctgaccgtgcacgtgaagagcagcgaccccgacatcgtggccgccagcagcagcctgatggccagaaagatcgagttcggcgtggacagcaccttcaaggccttcagcagcatgcccaaggacagcctgtgcttctacatcgtggagagagactactgcaacagctgcaagaacgaggagacccagagatgcgtgaacgccaagctggagcagccccagagcatcctgatcgagcacaccggcaccatcatcggcaagcagaacgacacctgcggcagcagaaccagctgctggctggacagcttcaagagcttcttctacggcctgaagagcatgctgagcggcatcttcggcaacgtgttcctgggcatcttcctgttcctggcccccttcgccctgctgctgttcttcttcttcttcggctggagaatcctgttctgcttcaagtgctgcagaagaaccagaggcctgttcaagtacagacacatcaaggacgacgaggaggtgggctacaagaagatcatcgagagactgaacaacaagaagggcaagcacagactgctggacggcgagagactggccgacagaaagatcgccgagctgttcagcaccaagacccacatcggctga

SEQ ID NO: 8625 - RNA, 5085 nt, synthetic construct
  misc_feature 1..5085: note = derived and/or modified CDS sequence (opt4) from CCHFV(UCCR4413)__KY484038.1__GP
  source 1..5085: mol_type = other RNA
atgctgagatacatcctgtacgccctgctggccagcgccatcctgcaccagcacctgtacaaggtgggcgccgacacccagaagcccaccgtgagaaccaacaccacccacaagatcagccccaccgccaccgccaacagaaccacctacgagcaggccacccccagcaccacccccaagagcagcaccaagcccaccacccacatcgccaccgcccacctggccgagagcgacggcagcggcgagaccaccctgctgctgcccaccaccgccagccagtacaccaccgagggccagaccagcctggagcccaccgccgaggagaccggcagcaacaccatccccagcgacaccaccagcaccagccccatcaccgagaacagcgagagcaccgacacccagatgaacgtgagcgacagcagcagcagccccctggccacccagggcgccagaagccccgccagaaacctgctgagcgtgcccagcgtggagcccggccagcagaccacccccaagcagcccaccaccaagggcaccgtgacccccaccaccccccagcccaccaccagcagccccacccccgcccccaccagcgccaccctgagcaccaacagcagcagcatcagcacccccgtgcagaccagcagccccctgcagcccatggcccccagccacgagacccagcacgccctgtacaccaccagcaccgagagcaccctgagaaccctgagcgccgagagaatccaccccaccaacagaagcagaagaaacagcgaggtggagatcatcctgaccctgccccagggcctgaagaagtactacagcagactgctgaagctgctgcacctgaccatggaggaggacaccgagggcctgcaggagtggtgcgtgagagtgctgggccagacctgcgacgacagctacttccacaagagactggccgagttcttcatcaccggcaccggcttcttcaacgaggtgctgctgttcagaagccccagcacccccaccaccatcaagcccagccccaccggcagccccaccgtggagcccttcagaagctactacgccaagggcagcctgaccatcgacagcggctacttcagcgccaagtgctaccccagaaccagcaacagcggcctgcagctgatcaacctgacccagcacagcgtggagatcgccaacacccccggccccaagcacagcagcctgaagaccatcaactgcatcaacatcaaggccagcaccgacaaggagcacaacgaggtggagatcaacgtgctgctgccccaggtggccatcaacctgagcaactgccacgtgagcatcagaagccacgtgtgcgactacagcctggacaccgacggcaagatcagactgccccagatcagccacgagggcaccttcatccccggcacctacaagatcatcatcgacaagaagaacaagctgaacgacagatgcagcctgatcaccagctgcgtgatcaagggcagagagctgagaaagggccagagcaccctgagacagtacaagaccgagatcaagatcggccagaccagcagcggcagcagaagactgctgagcgagagcagcgccagcggctgcatcagcagaacccagatgatcaagagcgagaccgccgagatccacgacgacatctacggcggccccggcgagaagctgaccatctgcaacggcaccaccgtggtggaccagagactgggcagcgagctgggctgctacaccatcaacagaatcaagacctacaagctgtgcgagaacagcgtgaaggagaagacctgcgagatcgacagcgtgcccgtgaagtgcagacagggcctgtgcctgaagatcacccaggagggcagaggccacgtgaagctgagcagaggcagcgagatcgtgctggacatctgcgacagcagctgcgagctgatgatccccaagggcaccggcgacatcctggtggactgcagcggcggccagcagcacttcctgcaggacaacctggtggacctgggctgccccaacatccccctgctgggcaaggtggccatctacatctgcagaatgagcaaccaccccaagaccaccatggccttcctgttctggttcagcttcggctacgtgatcacctgcatcctgtgcaagatcctgttctacctgctgatcatcaccggcaccctgggcaagaagctgaagcagtacagagagctgaagccccagacctgcaccatctgcgagagcacccccgtgaacgccatcgacgccgagatgcacgacctgaactgcagctacaacatctgcccctactgcgccagcagactgaccagcgacggcctgatcagacacgtgaacctgtgccccaagagaaaggagaaggtggaggagaccgagctgtacctgaacctggagagaatcccctggttcgtgagaaagctgctgcaggtgagcgagagcaccggcgtggccctgaagagaagcagctggctgctgatcctggtgatcctgctgaccgtgagcatgagccccgtgcagagcgcccccatcaaccagcagagagccgtggaggcctaccaggccagagagggctacaccggcatctgcctgttcatcctgggcagcgtgctgttcatgaccagctggctgaccaagggcctgatcgacagcatcggcgacagcttcttccccggcctgttcgtgtgcaagacctgcagcatcggcagcatcaacggcttcgagatcgagagccacagatgctactgcagcctgctgtgctgcccctactgcagaacctgcagcgccgacaaggacagccaccagctgcacctgagcatctgcaagaagaagaaggccggcagcaacgtgatgctggccgtgtgcaagagaatgtgcttcaaggccaccatcgaggccagcaacagagtgctgctgatcagaagcatcatcaacaccaccttcatcatctgcatgctgatcctggtggtgtgcgtgatcagcaccagcgccgtggagatggaggacctgcccgccggcacctgggagagagaggaggacctgaccaacttctgccaccaggagtgccaggtgaccgagaccgagtgcctgtgcccctacgaggccttcgtgctgagaaagcccctgttcctgagcagcatcgtgaagggcaagaagaacctgctgaacagcgccagcctggagaccagcctgagcatcgaggccccctggggcgccatcaacgcccagagcaccttcaagcccaccatcagcaccgccaacatcgccctgagctggagcagcgtggagcacagaggcaacaaggtgctggtgagcggcagaagcgagagcatcatgaagctggaggagagaaccggcatcagctggaacctgggcgtggaggacgccagcgagagcagaatgctgaccgtgagcgtgatggacctgagccagatgtacctgcccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgcccagcgagatcgtgaccctgcaccccaagatcgaggagggcttcttcgacctgatgcacgtgcagaaggtgctgagcgccagcaccgtgtgcaagctgcagagctgcacccacggcgtggccggcgacctgcaggtgtaccacgtgggcaacctgctgaagggcgacaagatcaacggccacagcatccacaagatcgagccccacctgaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagagcttccacttccacagcaagagagtgaccgcccacggcgacaccccccagctggacctgaaggccagacccatgtacggcgccggcgagatcaccgtgctggtggaggtggccgacatggagctgcacagcaagaacatcgagatcagcggcctgaagttcgccagcctgacctgcagcggctgctacgcctgcagcagcggcatcagctgcaaggtgagaatccacgtggacgagcccgacgagctggccgtgcacgtgaagagcgacgacctggacgtggtggccgccagcagcagcctgatggccagaaagatcgagttcggcaccgacagcaccttcaaggccttcagcagcatgcccaaggagagcctgtgcttctacatcgtggagagagacttctgcaagagctgcgccgccgaggacacccagaagtgcgtgaaggccaagctggagcagccccagagcatcctgatcgagcacaagggcaccatcatcggcaagcagaacgacacctgcagcaccaagaccagctgctggctggagagcttcaagagcttcttctacggcctgaagaacatgctgagcggcgtgttcggcagcgccatcatgggcatcctgctgttcctggcccccttcatcctgctgatcctgttcttcttcttcggctggagaatcctgttctgcctgagatgctgcagaagaaccagaggcctgttcaagtacaagcacatcaaggacgacgaggaggccggctacaagaagatcatcgagaagctgaacaacaagaagggcggcaccagcaagctgctggacggcgagagactggccgacagaaagatcgccgagctgttcagcaccaaggcccacatcggctga

SEQ ID NO: 8626 - RNA, 5076 nt, synthetic construct
  misc_feature 1..5076: note = derived and/or modified CDS sequence (opt4) from CCHFV(SCT ex Afghanistan)__KC344856.1__GP
  source 1..5076: mol_type = other RNA
atgcaccacgcctaccagatcatgtacaccctgctggtgtgcgccatcctgtgcccccagccctggagcctggagggcacccacgtgcccctgaacggcaccaagcacaacggcaccggcatcaccgccgcccccggcggcagccagggccccaccagccccgccagcaccgccgtgagcctgacccccgaccccttcaccaccgagcccaccgccagcgccgtggagctggagagcagcggcgagggccacaccagcctgagcgtgaccacccagggcctgaccagccccgagaccacccccggcctgcccaccgtgaccgacaccggcgtgagcagcaccagcatcttcggcatcggcatcagagtggccggcgacacccccaccagcaccacccacaccggcctgcccagcagccccagcatgcccagcaccgcccagggcccccaccacgccgtgagaggcctgctgagcgtgagcagcaccagacccggcgaggccagcaccatcaccgtgcccggcgaggccggcaccgaggccaacagcagcagcagcgccatcagcaagaagcccgcccccagccccaccgccgaggccatcaccgaggccaacaacagcagcaaccccagacagcccgagctgagcacccagcccgccatccccggcctggtgaccagcagcgcccagcccatcctgctgcagagcgccaccagcaccgccgcccaggacatctaccccagccccaccaacagaagcaagagaaacctggagatggagatcatcctgaccctgagccagggcctgaagaagtactacggcaagatcctgagaatcctggacctgaccctggaggaggacaccgagggcctgctggagtggtgcaagagaaacctgggcctgacctgcaacgacaacttcttccaggagagaatcgaggagttcttcctgaccggcgagggccacttcaacgaggtgctgcagttcaagacccccagcaccctgagccccaccgagcccacccacaccagaacccccaccgtgaagcccttcaagagctacttcgccagaggcttcctgagcatcgacagcggctacttcagcgccaagtgctacagcaagaccagcaacagcggcctgcagctgatcaacatcacccagcaccccgccagaatcgccgacacccccggccccaagatcaccaacctgaaggccatcaactgcatcaacctgaaggccagcgtgttcaaggagcacagagagatcgagatcaacgtgctgctgccccaggtggccgtgaacctgagcaactgccacgtgctgatcaagagccacgtgtgcgactacagcctggacatcgacggcgccgtgagactgccccacgtgcaccacaagggcaccttcatccccggcacctacaagatcgtgatcgacaagagaaacaagcagaacgacagatgcaccctggtgaccaactgcgtgatcaagggcaaggagatcagaaagggccagagcgccctgagacagtacagaaccgagatcagaatcggcaaggccagcgccggcagcagaagactgctgagcgaggagagcggcgacgactgcatcagcagaacccagctgctgagaaccgagaccgccgaggtgcacaacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcaagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcttctgcaaggtgatcttctacctgctgatcgtggtgggcaccctgggcaagaagttcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacatcagcgtgtgcctgttcgtgctgggcggcatcctgttcgtggtgagctgcctgatcaagggcctggtggacagcgtgggcaacagcttcttccccggcctgagcatctgcaagacctgcagcatcggcagcgtgaacggcttcgagatcgagagccacaagtgctactgcagcctgctgtgctgcccctactgcagacactgcagcaccgacagagagatccaccagctgcacctgagcatctgcaagaagagaagaaccggcggcaacgtgatgctggccgtgtgcaagagaatgtgcttcagagccaccatggaggtgagcaacaaggtgctgttcatcagaaacatcatcaacaccaccttcgtgatctgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctgaacagcatcgtgaagggcatgaagaacctgctgaacagcaccaacctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagagcctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaagctgaacggccacatgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgacatcagcggcctgaagttcgccagcctgacctgcgccggctgctacgcctgcagcagcggcatcagctgcaaggtgagaatccacgtggacgagcccgacgagctgaccgtgcacgtgaagagcgaggaccccgacatcgtggccgccagcaccagcctgatcgccagaaagctggagctgggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagggcatcctgatcgagcacaagggcaccatcatcggcaagcagaacgacacctgcaccgccaaggccggctgctggctggagagcgtgaagagcttcttctacggcctgaagaacatgctgagcggcatcttcggcaacgtgttcatcggcatcttcctgttcctggcccccttcgtgctgctgatcctgttcttcatgttcggctggagactgctgttctgcttcaagtgctgcagaagaaccagaggcctgttcaagtacagacacctgaaggaggacgaggagagcggctacagaagaatcatcgagagactgaacaacaagaagggcaagaacaagctgctggacggcgagagactggccgacagaagaatcgccgagctgttcagcaccaagacccacatcggctga

SEQ ID NO: 8627 - RNA, 5070 nt, synthetic construct
  misc_feature 1..5070: note = derived and/or modified CDS sequence (opt4) from CCHFV(SPU 431/85)__KJ682812.1__GP
  source 1..5070: mol_type = other RNA
atgcccgtgaacatcatgtacacccccctggtgtgcgccgtgatctgcctgcagctgtggaacctgggcggcaccctggtgagcaccaacagaacccagcacaacgagaccggcaccgtggccacccccgagggcaccctgagacccagactgcccgtgagcaccgccctgcccaccaagagcgacagacccagcgtgggccccgccgccagcagcagcggcctggagggcagcggcgagcccaacaccagccccagcatcaccaccaagggcctgaccccccccgagaccacccccgccctgcccaccgccaccgacaccgacgccagcagcaccggcgtggtggacgtgagcacccagatgaccaaggacatccccatgagcaccgcctacaccaacccccccagcacccccagcgcccccagcaccccccagggcacccaccacaccgccagaggcctgctgagcgtggccagcaccaagagcgaggaggtgagcatgagcaccagccccgccaagaccagcaccgagaccagcagccccccccccgccaccagcgagacccccacccccagccccaccacccaggtgcccaccggcaacaacaaccccaacaccagcagacagcccacccccagcgcccagcccgccatgagcaaccccgccaccagccccgcccagcccaacctgagccagagcgccccccccaccgccgaccagggcgtgcaccccagccccaccaacagaagcaagagaaacctggagatcgagatcatcctgaccctgagccagggcctgagaaagtactacggcaagatcctgaagctgctggacctgaccctggaggaggacaccgagggcctgctggagtggtgcaagagaaacctgggcctgacctgcgacgacaacttcttccagaagagaatcgaggagttcttcctgaccggcgagggctacttcaacgaggtgctgcagttcaaggtgcccagcaccctgagcagcaccgagcccacccacaccagaccccccaccgtggagcccttcaagagctacttcgccaagggcttcctgagcatgaacagcggctacttcagcgccaagtgctaccccagaaccagcaacagcggcctgcagctgatcaacgtgaccaagcacagcgccaagatcgccgacacccccggccccaagatcaccaacctgaagaccatcaactgcatcaacctgagagccagcgtgttcaaggagcacagagaggtggagatcaacgtgctgctgccccaggtggccgtgaacctgagcaactgccacgcccagatcaagagccacgtgtgcgactacagcctggccaccgacggcatggtgagactgccccacatccaccacgagggcaccttcatccccggcacctacaagatcgtgatcgacaagaagaacaagcagaacgacagatgcaccctggtgaccaactgcgtgatcaagggcagagaggtgagaaagggccagagcgccctgagacagtacaagaccgagatcagaatcggcaaggccagcagcggcagcagaagactgctgagcgaggagagcgacggcgactgcatcagcagaacccagctgctgagaaccgagaccaccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcaactgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccatccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggccacggcaagaccatcgagacctaccaggccagagagggctacaccagcttctgcctgttcatcctgggcagcatcctgttcgtggtgagctgcctggtgaagggcctgatcgacagcgtgggcaacagcttcttccccggcctgagcatctgcaagacctgcagcatcggcagcatcaacggcttcgagatcgagagccacaagtgctactgcagcctgttctgctgcccctactgcagacactgccccgccgacagagagatccacaagctgcacctgagcatctgcaagaagagaaagaccggcagcaacgtgatgctggccgtgtgcaagagaatgtgcttcagagccaccatcgaggtgagcaacagagccctgctgatcagaaacatcatcaacaccaccttcgtggtgtgcatcctgaccctggccgtgtgcgtggtgagcaccagcgccgtggagatggagagcctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcagaaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagagagtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgaagatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacaccagaaagtgcgtgaacaccaagctggacagaccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggctga

SEQ ID NO: 8628 - RNA, 5070 nt, synthetic construct
  misc_feature 1..5070: note = derived and/or modified CDS sequence (opt4) from CCHFV(SPU 556/87)__KJ682811.1__GP
  source 1..5070: mol_type = other RNA
atgaccgtgaacaccgtgtgcacccccctggtgtgcgccgtgttctgcctgcagctgtggaacctgggcggcaccctggtgcccaccaacagaacccagcacaacaagaccggcaccatggccacccccgagggcaccctgggccccagactgcccgtgagcaccgccctgcccaccaagagcgacagacccagcgtgggccccgccgcccccagcagcggcctggagggcagcggcgagcccaacaccagccccagcatcaccaccaagggcctggccctgcccgagaccacccccgccccccccaccgccaccgacaccgacgccagcagcaccggcgtggtgaacgtgagcacccagatgaccaaggacatccccatgagcaccgcctacaccaacccccccagcacccccagcgcccccagcaccccccagggcacccaccacaccgccagaggcctgctgagcgtggccagcaccaagagcgaggaggtgagcatgagcaccagccccggcaagaccagcaccgagaccagcagccccccccccgccaccagcgagacccccgcccccagccccaccacccaggcccccaccggcaacaacaaccccaacaccagcagacagcccacccccagcgcccagcccgccatgagcaaccccaccaccagccccgcccagcccaacctgctgcagaacgccccccccaccgccgaccagggcgtgcaccccggccccaccaacagaagcaagagaaacctggagatggagatcatcctgaccctgagccagggcctgagaaagtactacggcaagatcctgaagttcctggacctgaccctggaggaggacaccgagggcctgctggagtggtgcaagagaaacctgggcctgacctgcgacgacaacttcttccagaagagaatcgaggagttcttcctgaccggcgagggctacttcaacgaggtgctgcagttcaaggtgcccagcaccctgagcagcaccgagcccacccacaccggcagccccaccgtggagcccttcaagagctacttcgccaagggcttcctgagcatgaacagcggctacttcagcgccaagtgctaccccagaaccagcaacagcggcctgcagctgatcaacgtgaccaagcacagcgccaagatcgccgacacccccggccccaagatcaccaacctgaagaccatcaactgcatcaacctgagagccagcgtgttcaaggagcacagagaggtggagatcaacgtgctgctgccccaggtggccgtgaacctgagcaactgccacgcccagatcaagagccacgtgtgcgactacagcctggccaccgacggcatggtgagactgcccagaatccaccacgagggcaccttcatccccggcacctacaagatcgtgatcgacaagaagaacaagcagaacgacagatgcaccctggtgaccaactgcgtgatcaagggcagagaggtgagaaagggccagagcgccctgagacagtacaagaccgagatcagaatcggcaaggccagcagcggcagcagaagactgctgagcgaggagagcgacggcgactgcatcagcagaacccagctgctgagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcagaatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggccacggcaagaccatcgagacctaccaggccagagagggctacaccagcttctgcctgttcatcctgggcagcatcctgttcatcgtgagctgcctggtgaagggcctgatcgacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgagcgccgtgtgcaagagaatgtgcttcagagccaccatcgaggtgagcaacagagccctgctgatcagaagcatcatcaacaccaccttcgccgtgtgcatcctgaccctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacacccagaagtgcgtgaacaccaagctggagagaccccagagcatcctgatcgagcacaagggcaccatcatcggcaagcagaacgacacctgcaccgccaaggccagctgctggctggagagcgtgaagagcttcttctacggcctgaagagcatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggctga

SEQ ID NO: 8629 - RNA, 5070 nt, synthetic construct
  misc_feature 1..5070: note = derived and/or modified CDS sequence (opt4) from CCHFV(SPU 18/88)__KJ682810.1__GP
  source 1..5070: mol_type = other RNA
atgcccttcaacatcatgtacacccccctgctgtgcgccatcctgtgcctgcagctgtggagcctggagggcatctacggcctgagcaacaagacccagcacaacgacaccagcaccatcaaggtgcccgaggagagccagaagaccagcctgcccgccaacaccgccagccccatcaccagcgaccccagcagcgccaccagcaccgccctggccagcggccccgagggcagcggcgacaccagcaccagccccagcgtgaccacccagggccccaccctgctggagaccacccccgagccccacaccaccatcgacatcgacgagagcagcaccgccatcgccgacatcagcacccagaccgtgaaggacatccccacccccaccacccacaccagcctgcccagcacccccagcgcccccaccatcccccaggaggcccaccacaccgccagaggcctgctgagcgtgaccagcaccaagcccggcgagaccagcacccccaccagccccggcgaggccagcaccgaggccagcagcccccagcccaccatcagcgagacccccagccccccccccaccacccaggcccccaccgagatcaacaaccccaacaccagcagacagcccatgcccagcacccagcccgccgcccccaacagcgtgaccccccccgtgcagcccaccttcagccagagcgacgtgagcaccgtggcccaggacatccaccccagccccaccaacagaagcaagagaaacctggagatggagatcatcctgaccctgagccagggcctgaagaagtactacggcaaggtgctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagccccaccgagcccgccagagtggagagccccaccgtggagcccttcaagagctacttcgccaagggcttcctgagcatggacagcggctacttcagcgccaagtgctaccccaagagcagcaacagcggcctgcagctgatcaacgtgacccagcacagcatcagaatcaccgacacccccggccccaagatcaccagcctgaagaccatcaactgcatcaacctgaaggccctggtgttcaaggagcacagagagatcgagatcaacgtgctgctgccccaggtggccgtgaacctgagcaactgccacgtgctgatcaagagccacgcctgcgactacagcctggacatcgacggccccgtgagactgcccagaatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatgggcttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagccacggcgagaccgtggaggtgtaccagaccagagagggctacaccagcatctgcctgttcgtgctgggcagcatcctgttcctggtgagctgcctgatgaagggcctggtggacagcgtgggcaacagcttcagccccggcctgagcatctgcaagacctgcagcatcggcagcatcaacggcttcgagatcgagagccacaagtgctactgcagcctgttctgctgcccctactgcagacactgcagcgccgacatcgagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccggcaaggccggctgctggctggagagcatcaagagcttcttctacggcctgaagaacatgctgagcggcatcttcggcaacgtgttcatcggcatcttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaagaacaagaagggcaagaacaagctgctggacggcgagagactggccgacagaaagatcgccgagctgttcagcaccaagacccacatcggctga

SEQ ID NO: 8630 - RNA, 5070 nt, synthetic construct
  misc_feature 1..5070: note = derived and/or modified CDS sequence (opt4) from CCHFV(SPU 497/88)__KJ682808.1__GP
  source 1..5070: mol_type = other RNA
atgcccttcaacatcatgtacacccccctgctgtgcgccatcctgtgcctgcagctgtggagcctggagggcatctacggcctgagcaacaagacccagcacaacgacaccagcaccatcaaggtgcccgaggagagccagaagaccagcctgcccgccaacatcgccagccccaccaccagcgacccccccagcgccaccagcaccgccagcgccagcggccccgagggcagcggcgacaccagcaccagccccagcgtgaccacccagggccccacccccctggagatcacccccgagccccacaccaccatcgacatcgacaagagcagcaccagcatcgccgacatcagcaccagaaccgtgaaggacatccccacccccaccacccacaccagcctgcccagcacccccagcgcccccaccatcccccaggaggtgcaccacaccgccagaggcctgctgagcgtgaccagcaccaagcccgaggaggccagcaccctgaccagccccggcgaggccagcaccgaggccagcagcccccagcccaccatcagcgagacccccagccccccccccaccacccaggcccccaccgagatcaacaaccccaacaccagcagacagcccatgcccagcacccagcccgccgcccccaacagcgtgaccccccccgtgcagcccaccttcagccagagcgacgtgagcaccgccgcccaggacatccaccccagccccaccaacagaagcaagagaaacctggagatggagatcatcctgaccctgagccagggcctgaagaagtactacggcaaggtgctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagccccaccgagcccgccagagtggagagccccaccgtggagcccttcaagagctacttcgccaagggcttcctgagcatggacagcggctacttcagcgccaagtgctaccccaagagcagcaacagcggcctgcagctgatcaacgtgacccagcacctgatcagaatcaccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgctgatcaagagccacgtgtgcgactacagcctggacatcgacggccccgtgagactgcccagaatccaccacgagggcaccttcatccccggcacctacaagatcgtgatcgacaagaagaccaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcaagggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggtgttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagccacggcgagaccgtggaggtgtaccagaccagagagggctacaccagcatctgcctgttcgtgctgggcggcatcctgttcctggtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacatcgagatccacaagctgcacctgagcatctgcaagaagagaaagacctggagcaacgtgatgctggccgtgtgcaagagaatgtgcttcagagccaccgtggaggtgagcaacaaggccctgctgatcagaaacatcatcaacaccaccttcgtggtgtgcatcctgatcctggccatctgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgagaaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccagagccagctgctggctggagagcatcaagagcttcttctacggcctgaagaacatgctgagcggcatcttcggcaacgtgttcatcggcatcttcctgttcttcgcccccttcatcatgctgatcctgttcttcatgttcggctggagaatcctgttctgcttcaagtgctgcagaagaaccagaggcctgttcaagtacagacacctgaaggacgacgaggaggtgggctacagaaagatcatcgagagactgaacaacaagaagggcaagaacaagctgctggacggcgagagactggccgacagaaagatcgccgagctgttcagcaccaagacccacatcggctga

SEQ ID NO: 8631 - RNA, 5070 nt, synthetic construct
  misc_feature 1..5070: note = derived and/or modified CDS sequence (opt4) from CCHFV(SPU 130/89)__KJ682807.1__GP
  source 1..5070: mol_type = other RNA
atgcccttcaacatcatgtacacccccctgctgtgcgccatcctgtgcctgcagctgtggagcctggagggcatctacggcctgagcaacaagacccagcacaacgacaacagcaccaccaaggcccccgaggagagccacaagaccagcctgcccgccaacaccgccagccccatcaccagcgacccccccagcaccaccagcaccaccagcgccagcggccccgagggcagcggcgacaccagcaccagcccccccgtgaccacccagggccccgccagccccgagaccacccccgagccccacaccaccatcgacatcgacaagagcagcaccgccatcgccgacatcagcacccagaccgtgaaggacatccccacccccaccacccacaccagcctgcccagcaccctgagcgcccccaccatcccccaggaggcccaccacaccgccagaggcctgctgagcgtgaccagacacaagcccggcgaggccagcaagcccaccagccccggcgaggccagcaccgaggccagcagcagccagcccaccatcagcgagacccccagccccccccccaccacccaggcccccaccgagatcaacaaccccaacaccagcagacagcccatgcccagcacccagcccgccgcccccagcagcgtgacccaccccgcccagcccacccccagccagagcgacgtgcccaccgccgcccaggacatccaccccagccccaccaacagaagcaagagaaacctggagatggagatcatcctgaccctgagccagggcctgaagaagtactacggcaaggtgctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagccccaccgagcccgccagagtggagagccccaccgtggagcccttcaagagctacttcgccaagggcttcctgagcatggacagcggctacttcagcgccaagtgctaccccaagagcagcaacagcggcctgcagctgatcaacgtgacccagcacctgatcagaatcaccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgctgatcaagagccacgtgtgcgactacagcctggacatcgacggccccgtgagactgcccagcatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagcccaactacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcagccacggcgagaccgtggaggtgtaccagaccagagagggctacaccagcatctgcctgttcgtgctgggcagcatcctgttcctggtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacatcgagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgagcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagcactgcaagagctgcagcaaggaggacacccagagatgcgtgaacaccaagctggagcagccccagagcatcctgatcgagcacaagggcaccatcatcggcaagcagaacgacacctgcaccgccaaggccagctgctggctggagagcatcaagagcttcttctacggcctgaagaacatgctgagcggcatcttcggcaacgtgttcatcggcgtgttcctgttcctggcccccttcatcatcctgatcctgttcttcatgttcggctggagaatcctgttctgcttcaagtgctgcagaagaaccagaggcctgctgaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggctga

SEQ ID NO: 8632 - RNA, 5070 nt, synthetic construct
  misc_feature 1..5070: note = derived and/or modified CDS sequence (opt4) from CCHFV(SPU 383/87)__KJ682806.1__GP
  source 1..5070: mol_type = other RNA
atgcccttcaacatcatgtacacccccctgctgtgcgccatcctgtgcctgcagctgtggagcctggagggcatctacggcctgagcaacagaacccagcacaacgacaccagcaccatcaaggtgcccgaggagagccagaagaccagcctgcccgccaacaccgccagccccatcaccagcgacccccccagcaccaccagcaccgccagcgccagcggccccgagggcagcggcgacaccagcaccagcccccccgtgaccacccagggccccaccccccccgagaccacccccgagccccacaccaccatcgacatcgacaagagcagcaccgccatcgccgacatcagcacccagaccgtgaaggacatccccacccccaccacccacaccagcctgcccagcaccctgagcgcccccaccatcccccaggaggcccaccacaccgccagaggcctgctgagcatcaccagcaccaagcccggcgaggccagcacccccatcagccccggcgaggccagcaccgaggccagcagcccccagcccaccatcagcgagacccccagccccccccccaccgcccaggcccccaccgagatcaacagccccaacaccagcagacagcccatgcccagcacccagcccgccgcccccaacagcgtgacccaccccgcccagcccacccccagccagagcgacgtgcccaccgccgcccaggacatccaccccaaccccatcaacagaagcaagagaaacctggagatggagatcatcctgaccctgagccagggcctgaagaagtactacggcaaggtgctgaagctgctggacctgaccctggaggaggacaccgagggcctgctggagagctgcaagagaaacctgggcctgacctgcgacgacaacttcttccagaagagaatcgaggagttcttcctgaccggcgagggccacttcaacgaggtgctgcagttcaagacccccagcaccctgagccccaccgagcccgccagagtggagagccccaccgtggagcccttcaagagctacttcgccaagggcttcctgagcatggacagcggctacttcagcgccaagtgctacagcaagagcagcaacagcggcctgcagctgatcaacgtgacccagcacctgatcagaatcaccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgctgatcaagagccacgtgtgcgactacagcctggacatcgacggccccgtgagactgcccagaatccaccacgagggcaccttcatccccggcacctacaagatcgtgatcgacaagaacaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctggtggtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatccagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagccacggcgagaccgtggaggtgtaccagaccagagagggctacaccagcatctgcctgttcgtgctgggcagcatcctgttcctggtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacatcgagatccacagactgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcttcggcaagcagaacgacacctgcaccgccaaggccagctgctggctggagagcgtgaagagcttcttctacggcctgaagaacatgctgagcggcatcttcggcaacgtgttcatcggcgtgttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggctga

SEQ ID NO: 8633 - RNA, 5070 nt, synthetic construct
  misc_feature 1..5070: note = derived and/or modified CDS sequence (opt4) from CCHFV(SPU 44/08)__KJ682805.1__GP
  source 1..5070: mol_type = other RNA
atgcccttcaacatcatgtacacccccctgctgtgcgccatcctgtgcctgcagctgtggagcctggagggcatctacggcctgagcaacaacacccagcacaacgacaccagcaccatcaaggtgcccgaggagagccagaagaccagcctgcccgccaacaccgccagccccatcaccagcgaccccccccccaccacccccaccgccagcgccagcggccccgagggcagcggcgacaccagcaccagcccccccgtgaccacccagggccccaccccccccgagaccacccccgagccccacaccaccatcgacatcgacaagagcagcaccgccatcgccgacatcagcacccagaccgtgaagaacatccccacccccaccgcccacaccagcctgcccagcaccctgagcgcccccaccatgccccaggaggcccaccacaccgccagaggcctgctgagcgtgaccagcaccaagcccggcgaggccagcacccccaccagccccggcgaggccagcaccgaggccagcagcccccagcccaccatcagagagacccccagccccccccccaccacccagacccccaccgagatcaacaaccccaacaccagcagacagcccatgcccagcacccagcccgccgcccccagcagcgtgacccaccccgcccagcccacccccagccagagcgacgtgcccaccgccgcccaggacatccaccccagccccaccaacagaagcaagagaaacctggagatggagatcatcctgaccctgagccagggcctgaagaagtactacggcaaggtgctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagccccaccgagcccgccagagtggagagccccaccgtggagcccttcaagagctacttcgccaagggcttcctgctgatggacagcggctacttcagcgccaagtgctaccccaagagcagcaacagcggcctgcagctgatcaacgtgacccagcacctgatcagaatcaccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgctgatcaagagccacgtgtgcgactacagcatcgacatcgacggccccgtgagactgcccagaatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagccacggcgagaccgtggaggtgtaccagaccagagagggctacaccagcatctgcctgttcgtgctgggcagcatcctgttcctggtgagctgcctgatgagaggcctggtggacagcgtgagcaacagcttcttccccggcctgagcatctgcaagacctgcagcatcggcagcatcaacggcttcgagatcgagagccacaagtgctactgcagcctgttctgctgcccctactgcagacactgcagcgccgacatcgagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcatcaagagcttcttctacggcctgaagaacatgctgagcggcatcttcggcaacgtgttcatcggcatcttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggctga

SEQ ID NO: 8634 - RNA, 5070 nt, synthetic construct
  misc_feature 1..5070: note = derived and/or modified CDS sequence (opt4) from CCHFV(Matin)__AF467769.2__GP
  source 1..5070: mol_type = other RNA
atgagcttcaacatcatgtacaccctgctgctgtgcgccatcctgtgcagccagctgtggagcagcgagggcatccacggcctgagcaacgagacccagcacggcaacgccagcaccatcaaggcccccgaggtgagccagggcctgggcctgcccgtgagcaccgccccccccatcaccagcgacccccccagcatcaccagcgccgccagcgtgagcggccccgagggcagcggcgacaccaacaccagcccccccgtgaccacccagggcctgaccctgcccgagaccaccctggagctgctgaccaccaccaacaccggcgccagcagcaccgtgatcgtggacgtgagcacccagaccgtgaaggacacccccgtgagcaccgcccacaccagcccccccggcacccccagcgcccccaccaccccccagggcacccaccacaccgccagaggcctgctgagcgtgaccagcaccaagagcgaggaggccagcacccagaccaaccccaagaagaccagcatggagaccaacagccccggccccgccaccagcgagacccccagccccagccccaccacccaggcccccaccgagaacaacaaccccaacacccccagacagcccaccccccccacccagcccgccacccccagccccgtgaccagccccgccctgctggccagcagccagggcgacaccagcaccgccgtgcaggacgtgcaccccagccccaccaacagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacagcttcttccagaagagaatcgaggagttcttcctgaccggcgagggccacttcaacgaggtgctgcagttcaagacccccagcaccctgagccccaccgagcccgccagagccggcagccccaccgtggagcccttcaagagctacttcgccagaggcctgctgagcatggacagcggctacttcagcgccaagtgctaccccagagccagcaacagcggcctgcagctgatcaacatcacccagcacagcgccagaatcaccgacacccccggccccaagatcaccaacctgaagaccatcaactgcatcaacctgaaggccagcaccttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagatcgtgatcgacaagaagaacaagcagaacgacagatgcaccatcgtgaccaactgcgtgatcaagggcagagagatcagaaagggccagagcgtgctgagacagtacaagaccgagatcaagatcggcaaggccagcagcggcagcagaagactgctgagcgaggagagcggcgacgactgcatcagcagaacccagctgctgagaaccgagaccgccgagatccacagcgacagctacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggtgttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagatcagagagggctacaccagcgtgtgcctgttcgtgctgggcagcatcctgttcatcgtgagctgcctgatgaagggcctggtggacagcgacggcaacagcttcttccccggcctgagcatctgcaagacctgcagcatcggcagcatcaacggcttcgagatcgagagccacaagtgctactgcagcctgttctgctgcccctactgcagacactgcagcaccgacagagagatccacaagctgcacctgagcatctgcaagaagagaaagaccggcagcaacgtgatgctggccgtgtgcaagagaatgtgcttcagagccaccgtggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgatcaacttctgccaccaggagtgccaggtgaccgagaccgagtgcctgtgcccctacgaggccctggtgctgagaaagcccctgttcctggacagcatcatcaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggtgatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgagcatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcgccctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacgtgggctga

SEQ ID NO: 8635 - RNA, 5070 nt, synthetic construct
  misc_feature 1..5070: note = derived and/or modified CDS sequence (opt4) from CCHFV(TADJ/HU8966)__AY179962.1__GP
  source 1..5070: mol_type = other RNA
atgcccgtgagcatcatgcacatgctgctgatgtgcgccgtgctgtgcctgcagctgtacggcctgggcggcaccctgagaagcaacaacggcaccgagcacaacaagaccaacgtgctgaccacccccggcgacaagctgagccccgagccccccgtgagcaccgccctgcccgtgacccccgacagcagcaccgtgacccccaccacccccgccagcggcctggagggcagcggcgaggtgtacaccagcccccccatcaccaccaagggcctgagccccagcgaggccaccagcgagccccccgccaccaccggcatgggcatcagcagcgccagcggcgtggacttcagcacccaggccgccagagacaccagcaccctgaccgtgctgaccagcccccccaacagccccaacaccccccccaccagccaggacacccaccaccccgtgagaagcctgctgagcgtgaccagccccagacccgaggagaccaccgcccccagcaagagcggcaaggagagccccgccgccaacagcagccaccccgtgaccagcagacccagcagccccctgatcaccgtgagaggccccaccgagaacagcagccacaacaccaccggccagctggagagcatgacccagagcaccaccctggtgcccatggccagccccacccagaccgtgctgagccagagcgtgaccagcatcgccgtgcaggacgcccaccccagcagcaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccacgccggcagccccaccgccgagcccttcaagagctacttcgccaagggcttcctgagcatcgacagcggctacttcagcgccaagtgctacagcagaaccagcaacagcggcctgagactgatcaacgtgaccagacacagcaccagaatcgccgacacccccggccccaagatcaccaacctgaagaccatcagctgcatcaacctgagagccagcatcttcaaggagcacagagaggtggagatcaacgtgctgctgccccaggtggccgtgaacctgagcaactgccacgtggccatcaagagccacgtgtgcgactacagcctggacgtggacggcaccgtgagactgccccacatccaccacggcggcaccttcatccccggcacctacaagatcgtgatcgacaagaagaacaagctgaacgacagatgcaccctgttcaccaactgcgtgatcaagggcagagaggtgagaaagggccagagcatcctgagacagtacaagaccgagatcagaatcggcaaggccagcaccggcagcagaagactgctgagcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcagcgtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcaccagaatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagagagtggaggagaccgagctgtacctgaacctggagagaatcccctggatcgtgagaaagctgctgcaggtgagcgagagcaccggcgtggccctgaagagaagcagctggctgatcgtgctgctggtgctgttcaccgtgagcctgagccccgtgcagagcgcccccatcggctacggcaacaccatcgagacctaccaggccagagaggagtacaccagcatctgcctgttcgtgctgggcagcatcctgttcatcgtgagctgcctgatgaagggcctggtggacagcatcggcaacatcttcttccccggcctgaccatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcatcgtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaaccccctgaacagcaccagcctggagaccagcctgagcatcgaggccccctggggcgccatcaacgtgcagagcacctacaagcccaccgtgagcaccgccaacatcgccctgagctggagcagcatcgagcacagaggcaacaacatcctggtgagcggcagaagcgagagcatcatgaagctggaggagagaaccggcatcagcggcgacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcatcgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggagaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtacagaaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgagctgcttcaagtgctgcagaagaaccagaggcctgctgaagcacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8636 - RNA, 5070 nt, synthetic construct
  misc_feature 1..5070: note = derived and/or modified CDS sequence (opt4) from CCHFV(88166)__AB069675.1__GP
  source 1..5070: mol_type = other RNA
atgagcttcagcgtgatgtacacccccctgctgtgcgccgtgctgtgcctgcagctgtggagcctggagggcagccacggcctgagcaacaagacccagcacagcaacaccagcaccaccaaggcccccgaggtgagccaggagctgggcctgcccgtgagcaccgtgagcaccatcaccagcgacccccccagcatcaccagcgccgtgagcgtgagcggcagcgagggcagcggcgacaccaacaccagccccagcgtgaccacccagggccccaccctgcccgagaccaccctggagcccctgaccaccaccgacaccgacgccagcagcaccgtggtggtggacgtgagcacccagaccgtgaaggacacccccatcagcaccacctacaccagcctgcccagcacccccagcgagcccaccaccccccagggcacccaccacaccgccagaggcctgctgagcgtgaccagcaccaagcccgaggaggccagcacccaggccaaccccggcaagatcagcatggagaccaacagccccagactggccatcagcgagacccccagcttcagccccaccacccaggcccccaccgagaacagcaaccccatcaccagcaagcagctgatgctgagcgcccagcccgtgacccccaaccccatgaccagccccgtgcagcccgccctgagccagagcgacaccagcaccgccatccaggacatccaccccagccccaccggcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacaacttcttccagaagagaatcgaggagttcttcctgaccggcaagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaagatcaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgctgagaaccgagaccgccgagatccacagcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatgggcttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacagactgcacctgagcatctgcaagaagagaaagacctggagcaacgtgatgctggccgtgtgcaagagaatgtgcttcagagccaccgtggaggtgagcaacaaggccctgctgatcagaaacatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctggaacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacctggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8637 - RNA, 5070 nt, synthetic construct
  misc_feature 1..5070: note = derived and/or modified CDS sequence (opt4) from CCHFV(8402)__AB069674.1__GP
  source 1..5070: mol_type = other RNA
atgagcttcagcgtgatgtacacccccctgctgtgcgccgtgctgtgcctgcagctgtggagcctggagggcagccacggcctgagcaacaagacccagcacagcaacaccagcaccaccaaggcccccgaggtgagccaggagctgggcctgcccgtgagcaccgtgagcaccatcaccagcgacccccccagcatcaccagcgccgtgagcgtgagcggcagcgagggcagcggcgacaccaacaccagccccagcgtgaccacccagggccccaccctgcccgagaccaccctggagcccctgaccaccaccgacaccgacgccagcagcaccgtggtggtggacgtgagcacccagaccgtgaaggacacccccatcagcaccacctacaccagcctgcccagcacccccagcgagcccaccaccccccagggcacccaccacaccgccagaggcctgctgagcgtgaccagcaccaagcccgaggaggccagcacccaggccaaccccggcaagatcagcatggagaccaacggccccagactggccatcagcgagacccccagcttcagccccaccacccaggcccccaccgagaacagcaaccccatcaccagcaagcagctgatgctgagcgcccagcccgtgacccccaaccccatgaccagccccgtgcagcccgccctgagccagagcgacaccagcaccgccatccaggacgtgcaccccagccccaccggcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacaacttcttccagaagagaatcgaggagttcttcctgaccggcaagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaagatcaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgctgagaaccgagaccgccgagatccacaacgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacagactgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagagcaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8638 - RNA, 5070 nt, synthetic construct
  misc_feature 1..5070: note = derived and/or modified CDS sequence (opt4) from CCHFV(7803)__AB069672.1__GP
  source 1..5070: mol_type = other RNA
atgcccgtgagcatcatgcacatcagcctgatgtgcgccgtgctgtgcctgcagctgtacggcctgggcgagacccacggcagcagcaacgagaccgagcacaacaagaccaacgtggtgaccacccccggcgacagccagagccccgagcccctggtgagcaccaccctgcccgtgaccctggacagcagcaccgtgacccccaccacccccgccagcgagcccgagggcagcggcgaggtgtacaccagcccccccatcaccaccgagggcctgagccccagcgaggccaccagcgagctgcccgtgaccaccggcatcggcatcagcagcgccagcgacgtggacagcagcacccaggccgccggcgacaccagcacccccaccgtgagaaccagcccccccaacagccccagcaccccccccaccagccaggacacccaccaccccatgagaaacctgctgagcgtgaccagcctgaagagcgaggagaccagcgcccccagcaagagcggcaaggagagccccgccgccagcagcccccaccccgtggccagcagaccccccacccaccccatcaccgcccagggccccaccgagaacaacagccacaacaccaccggccagctggagagcgtgacccagagcgccaccctgggccccatggccagccccacccagaccgtgctgagccagaacgtgaccagcatcgccatccaggacacccaccccagccccaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccacgccgagagccccaccgccgagcccttcaagagctacttcgccaagggcttcctgagcatcgacagcggctacttcagcgccaagtgctacagcagaaccagcgacagcggcctgcagctgatcaacgtgaccagacacagcaccagaatcgccgacacccccggccccaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacatcgacggcaccgtgagactgccccacatccaccacgagggcaccttcatccccggcacctacaagatcgtgatcgacaagaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgaggagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtgatcctggacgcctgcgacagcagctgcgaggtgatgatccccaagggcaccggcgacatcctggtggactgcagcggcggccagcagcacttcctgaaggacaacctgatcgacctgggctgccccagcatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccatcagcctgagccccgtgcagagcgcccccatcagccacggcaagaccatcgagacctaccaggccagagaggagtacaccagcatctgcctgttcgtgctgggcagcatcctgttcatcgtgagctgcctgatgaagggcctggtggacagcatcggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgcctgcaagagaatgtgcttcagagccaccatggaggtgagcaacaaggccctgctgatcagaagcatcatcaacaccaccttcgtggtgtacatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgagaggcatgaagaaccccctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgatcgtgaagtggaaggtggagtacatcaagaccagaggcatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacctgatccacaagatcgagccccacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagttcacccccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacttcttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8639 - RNA, 5070 nt, synthetic construct
  misc_feature 1..5070: note = derived and/or modified CDS sequence (opt4) from CCHFV(75024)__AB069671.1__GP
  source 1..5070: mol_type = other RNA
atgcccgtgagcatcatgcacatcagcctgatgtgcgccgtgctgtgcctgcagctgtacggcctgggcgagacccacggcagcagcaacgagaccgagcacaacaagaccaacgtggtgaccacccccggcgacagccagagccccgagcccctggtgagcaccaccctgcccgtgaccctggacagcagcaccgtgacccccaccacccccgccagcggccccgagggcagcggcgaggtgtacaccagcccccccatcaccaccgagggcctgagccccagcgaggccaccagcgagctgcccgccaccaccggcatcggcatcagcagcgccagcgacgtggacagcagcacccaggccgccggcgacaccagcacccccaccgtgagaaccagcccccccaacagcagcagcaccccccccaccagccaggacacccaccaccccatgagaaacctgctgagcgtgaccagcctgaagcccgaggagaccagcgcccccagcaagagcggcaaggagagccccgccgccagcagcccccaccccgtggccagcagaccccccaccccccccaccaccgcccagggccccatcgagaacaacagccacaacaccaccggccagctggagagcgtgacccagagcgccaccctgggccccatggccagccccacccagaccgtgctgagccagaacgtgaccagcatcgccatccaggacacccaccccagccccaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccacgccgagagccccaccgccgagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacatcgacggcaccgtgagactgccccacatccaccacgagggcaccttcatccccggcacctacaagatcgtgatcgacaagaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgaggagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagcatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccatcagcctgagccccgtgcagagcgcccccatcggccacggcaagaccatcgagacctaccaggccagagaggagtacaccagcatctgcctgttcgtgctgggcagcatcctgttcatcgtgagctgcctgatgaagggcctggtggacagcatcggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgagaggcatgaagaaccagctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgatcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacctgatccacaagatcgagccccacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagttcacccccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacctgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8640 - RNA, 5070 nt, synthetic construct
  misc_feature 1..5070: note = derived and/or modified CDS sequence (opt4) from CCHFV(66019)__AB069669.1__GP
  source 1..5070: mol_type = other RNA
atgcccgccaacatcatgtacaccctgctggtgtgcgccgtgctgtgcccccagctgtggagcctggagggcacccacgtgccccacaacgagaccaagcacaacggcaccggcatcaccgccgcccccggcgagagccagggccccatgagccccgccagcaccgccgtgcccctgacccccgagccccccaacaccaagcccgccgccagcgccagcgagctggagagcagcggcgagggccacaccagcctgctggccaccacccagggcctgaccagccccgaggccacccccgagctgcccaccaccaccgacaccggcgtgagcagcaccagcgtggtggacatcggcacccagatggccaaggacacccccaccagcaccgcccacaccagcctgcccagcaaccccagcgcccccagcaccgcccagggcacccaccacaccatcagaggcctgctgagcgtgaccagcaccaagcccgaggaggccagcacccccaccgaccccggcaaggccggcgccgagaccggcagccccagacccgccatcagcagaaagcccaccctgagccccaccgccgaggcccccaccgagatcaacaacagcagcacccccaagcagcccgagcccagcatccagcccgccacccccagcctggtgatcagccccgcccagcccgccttcccccagagcgccaccagcaccgccgcccaggacatctacagcagccccaccaacagaagcaagagaaacctgaagatggagatcatcctgaccctgagccagggcctgaagaagtactacggcaagatccagaagaccctgggcctgaccctggaggaggacaccgagggcctgctggagtggtgcaagagaaacctgggcctgacctgcgacgacaacttcttccagaagagaatcgaggagttcttcctgaccggcgagggctacttcaacgaggtgctgcagttcaagacccccagcacccccggcagcaccgagcccacccacaccgaggcccccaccgtgaagcccttcaagagctacttcgccagaggcttcctgaccatcgacagcggctacttcagcgccaagtgctacagcagaaccagcaacagcggcctgcagctgatcaacgtgacccagcaccccgccagaatcgccgacacccccggccccaagatcaccaacctgaagaccatcaactgcatcaacctgaaggccagcgtgttcaaggagcacagagagatcgagatcaacgtgctgctgccccaggtggccgtgaacctgagcaactgccacgtgctgatcaagagccacgtgtgcgactacagcctggacatcgacggcaccatcagactgcccagaatctaccacgagggcaccttcatccccggcacctacaagatcgtgatcgacaagagagacaagcagaacgacagatgcaccctggtgaccaactgcgtgatcaagggcagagaggtgagaagaggccagagcgccctgagacagtacagaaccgagatcagaatcggcaaggccagcgccggcagcagaagactgctgagcgaggagagcggcgacgactgcatcagcagaacccagctgctgagaaccgagaccgccgaggtgcacggcgacaactacggcggccccggcgacaagatcaccatctgcaacggcagcaccatcgtggaccagagactgggcagcgagctgggctgctacaccatcaacagagtgaagagcttcaagctgtgcgagaacagcggcaccggcaagagctgcaagatcgacaacacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcttctgcaagatcatcttctacctgctgatcgtggtgggcaccctgggcaagaagttcaagcagtacagagagctgaagccccagacctgcaccatctgcgagaccacccccaccaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgaggcctaccagaccagagagggctacaccagcgtgtgcctgttcatgctgggcggcatcctgttcgtggtgagctgcctgatgaagggcctggtggacagcgtgagcaacagcttcttccccggcctgagcatctgcaagacctgcagcatcggcagcgtgaacggcttcgagatcgagagccacaagtgctactgcagcctgctgtgctgcctgtactgcagacactgcagcgccgacagagagatccaccagctgcacctgagcatctgcaagaagagaagagccggcggcaacgtgatgctggccgtgtgcaagagaatgtgcctgagagccaccatggaggtgagcaacaaggtgctgttcatcagaagcatcatcaacaccaccttcgtgatctgcatcctggtgctggccgtgtgcatcgtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcaactgccccgacagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaacagccaggagagacagtgcagcctgatcgaggccggcaccagattcaacctgggccccgtgaccatcaccctgagcgagcccagaaacatccagcagaagctgcccagcgagatcatcaccctgcaccccagaatcgaggagggcttcttcgacctgatgcacgtgcagaaggtgctgagcgccagcaccgtgtgcaagctgcagagctgcacccacggcgtgcccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgccatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagatacctgaaggacgacgaggagagcggctacagaagaatcatcgagagactgaacaacaagaagggcaagaacaagctgctggacggcgagagactggccgacagaagaatcgccgagctgttcagcaccaagacccacatcggctga

SEQ ID NO: 8641 - RNA, 5070 nt, synthetic construct
  misc_feature 1..5070: note = derived and/or modified CDS sequence (opt4) from CCHFV(BA8402)__AF350449.1__GP
  source 1..5070: mol_type = other RNA
atgagcttcagcgtgatgtacacccccctgctgtgcgccgtgctgtgcctgcagctgtggagcctggagggcagccacggcctgagcaacaagacccagcacagcaacaccagcaccaccaaggcccccgaggtgagccaggagctgggcctgcccgtgagcaccgtgagcaccatcaccagcgagccccccagcatcaccagcgccgtgagcgtgagcggcagcgagggcagcggcgacaccaacaccagccccagcgtgaccacccagggccccaccctgcccgagaccaccctggagcccctgaccaccaccgacaccgacgccagcagcaccgtggtggtggacgtgagcacccagaccgtgaaggacacccccatcagcaccacctacaccagcctgcccagcacccccagcgagcccaccaccccccagggcacccaccacaccgccagaggcctgctgagcgtgaccagcaccaagcccgaggaggccagcccccaggccaaccccggcaagatcagcatggagaccaacggccccagactggccatcagcgagacccccagcttcagccccaccacccaggcccccaccgagaacagcaaccccatcaccagcaagcagctgatgctgagcgcccagcccgtgacccccaaccccatgaccagccccgtgcagcccgccctgagccagagcgacaccagcaccgccatccaggacgtgcaccccagccccaccggcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacaacttcttccagaagagaatcgaggagttcttcctgaccggcaagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaagatcaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgctgagaaccgagaccgccgagatccacaacgacaactacggcggccccggcgacaagatcaccatctgcaacggcagcaccgtggtggaccagagactgggcagcgagctgggctgctacaccatcaacagagtgaacagcttcaacctgtgcgagaacaccgccaccggcaagagctgcgagatcgacagcacccccgtgaagtgcagacagggcttctgcctgaagatcacccaggagggcagaggccacgtgaagctgagcagaggcagcgaggtggtgctggacgcctgcgagagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagacccaccagcgacggcctggccagacacgtgatgcagtgccccaagagaaaggagaagatcgaggagaccgccctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacagactgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctgcactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagagcaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8642 - RNA, 5070 nt, synthetic construct
  misc_feature 1..5070: note = derived and/or modified CDS sequence (opt4) from CCHFV(BA66019)__AF350448.1__GP
  source 1..5070: mol_type = other RNA
atgcccgccaacatcatgtacaccctgctggtgtgcgccgtgctgtgcccccagctgtggagcctggagggcacccacgtgccccacaacgagaccaagcacaacggcaccggcatcaccgccgcccccggcgagagccagggccccatgagccccgccagcaccgccgtgcccctgacccccgagccccccaacaccaagcccgccgccagcgccagcgagctggagagcagcggcgagggccacaccagcctgctggccaccacccagggcctgaccagccccgaggccacccccgagctgcccaccaccaccgacaccggcgtgagcagcaccagcgtggtggacatcggcacccagatggccaaggacacccccaccagcaccgcccacaccagcctgcccagcaaccccagcgcccccagcaccgcccagggcacccaccacaccatcagaggcctgctgagcgtgaccagcaccaagcccgaggaggccagcacccccaccgaccccggcaaggccggcgccgagaccggcagccccagacccgccatcagcagaaagcccaccctgagccccaccgccgaggcccccaccgagatcaacaacagcagcacccccaagcagcccgagcccagcatccagcccgccacccccagcctggtgatcagccccgcccagcccgccttcccccagagcgccaccagcaccgccgcccaggacatctacagcagccccaccaacagaagcaagagaaacctgaagatggagatcatcctgaccctgagccagggcctgaagaagtactacggcaagatccagaagaccctgggcctgaccctggaggaggacaccgagggcctgctggagtggtgcaagagaaacctgggcctgacctgcgacgacaacttcttccagaagagaatcgaggagttcttcctgaccggcgagggctacttcaacgaggtgctgcagttcaagacccccagcacccccggcagcaccgagcccacccacgccgaggcccccaccgtgaagcccttcaagagctacttcgccagaggcttcctgaccatcaacagcggctacttcagcgccaagtgctacagctggaccagcaacagcggcctgcagctgatcaacgtgacccagcaccccgccagaatcgccgacacccccggccccaagatcaccaacctgaagaccatcaactgcatcaacctgaaggccagcgtgttcaaggagcacagagagatcgagatcaacgtgctgctgccccaggtggccgtgaacctgagcaactgccacgtgctgatcaagagccacgtgtgcgactacagcctggacatcgacggcaccatcagactgcccagaatctaccacgagggcaccttcatccccggcacctacaagatcgtgatcgacaagagagacaagcagaacgacagatgcaccctggtgaccaactgcgtgatcaagggcagagaggtgagaaagggccagagcgccctgagacagtacagaaccgagatcagaatcggcaaggccagcgccggcagcagaagactgctgagcgaggagagcggcgacgactgcatcagcagaacccagctgctgagaaccgagaccgccgaggtgcacggcgacaactacggcggccccggcgacaagatcaccatctgcaacggcagcaccatcgtggaccagagactgggcagcgagctgggctgctacaccatcaacagagtgaagagcttcaagctgtgcgagaacagcggcaccggcaagagctgcaagatcgacaagcaccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcttctgcaagatcatcttctacctgctgatcgtggtgggcaccctgggcaagaagttcaagcagtacagagagctgaagccccagacctgcaccatctgcgagaccacccccaccaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgaggcctaccagaccagagagggctacaccagcgtgtgcctgttcatgctgggcggcatcctgttcgtggtgagctgcctgatgaagggcctggtggacagcgtgagcaacagcttcttccccggcctgagcatctgcaagacctgcagcatcggcagcgtgaacggcttcgagatcgagagccacaagtgctactgcagcctgctgtgctgcctgtactgcagacactgcagcgccgacagagagatccaccagctgcacctgagcatctgcaagaagagaagagccggcggcaacgtgatgctggccgtgtgcaagagaatgtgcctgagagccaccatggaggtgagcaacaaggtgctgttcatcagaagcatcatcaacaccaccttcgtgatctgcatcctggtgctggccgtgtgcatcgtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgacagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaacagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgccatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagatacctgaaggacgacgaggagagcggctacagaagaatcatcgagagactgaacaacaagaagggcaagaacaagctgctggacggcgagagactggccgacagaagaatcgccgagctgttcagcaccaagacccacatcggctga

SEQ ID NO: 8643 - RNA, 5070 nt, synthetic construct
  misc_feature 1..5070: note = derived and/or modified CDS sequence (opt4) from CCHFV(BA88166)__AF338470.1__GP
  source 1..5070: mol_type = other RNA
atgagcttcagcgtgatgtacacccccctgctgtgcgccgtgctgtgcctgcagctgtggagcctggagggcagccacggcctgagcaacaagacccagcacagcaacaccagcaccaccaaggcccccgaggtgagccaggagctgggcctgcccgtgagcaccgtgagcaccatcaccagcgacccccccagcatcaccagcgccgtgagcgtgagcggcagcgagggcagcggcgacaccaacaccagccccagcgtgaccacccagggccccaccctgcccgagaccaccctggagcccctgaccaccaccgacaccgacgccagcagcaccgtggtggtggacgtgagcacccagaccgtgaaggacacccccatcagcaccacctacaccagcctgcccagcacccccagcgagcccaccaccccccagggcacccaccacaccgccagaggcctgctgagcgtgaccagcaccaagcccgaggaggccagcacccaggccaaccccggcaagatcagcatggagaccaacagccccagactggccatcagcgagacccccagcttcagccccaccacccaggcccccaccgagaacagcaaccccatcaccagcaagcagctgatgctgagcgcccagcccgtgacccccaaccccatgaccagccccgtgcagcccgccctgagccagagcgacaccagcaccgccatccaggacatccaccccagccccaccggcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacaacttcttccagaagagaatcgaggagttcttcctgaccggcaagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaagatcaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgctgagaaccgagaccgccgagatccacagcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatgggcttcctgttctggttcagcttcggctacgtggtgacctgcatcctgtgcaagggcatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacagactgcacctgagcatctgcaagaagagaaagacctggagcaacgtgatgctggccgtgtgcaagagaatgtgcttcagagccaccgtggaggtgagcaacaaggccctgctgatcagaaacatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgtacctggacagcatcgtgaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctggaacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgatcatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8644 - RNA, 5070 nt, synthetic construct
  misc_feature 1..5070: note = derived and/or modified CDS sequence (opt4) from CCHFV(UCCR4459)__KY484032.1__GP
  source 1..5070: mol_type = other RNA
atgagcttcagcatcatgtacacccccctgctgtgcgccgtgctgtgcctgcagctgtggagcctggagggcagccacggcctgagcaacaagacccagcacagcaacaccagcaccaccaaggcccccgaggtgagccaggagttcggcctgcccgtgagcaccgtgagcaccatcaccagcgacccccccagcatcaccagcgccgtgagcgtgagcggcagcgagggcagcggcgacaccaacaccagccccagcgtgaccacccagggcctgaccctgcccgagaccaccctggagctgctgaccaccaccgacaccgacgccagcagcaccgtggtggtggacgtgagcacccagaccgtgaaggacacccccatcagcaccacccacaccagcctgcccagcacccccagcgccaccaccaccccccagggcacccaccacaccgccagaggcctgctgagcgtgaccagcaccaagcccgagggcgccagcacccaggccaaccccgagaagatcagcatggagaccaacagccccagactggccatcagcgagacccccagcttcagccccaccacccaggcccccaccgagaacagcaaccccatcaccagcaagcagctgatcttcagcgcccagcccgtgacccccaaccccgtgaccccccccgtgcagcccgccctgagccagagcgacaccagcaccgccatccaggacatccaccccagccccaccagcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacgacttcttccagaagagaatcgaggagttcttcctgaccggcgagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaaggtgaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagctggtgatcgacaagaagaacaagcagaacgacagatgcaccctgatcaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgagcagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccatcaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8645 - RNA, 5070 nt, synthetic construct
  misc_feature 1..5070: note = derived and/or modified CDS sequence (opt4) from CCHFV(K168_125)__KX013460.1__GP
  source 1..5070: mol_type = other RNA
atgcccatcagcaccatgcacatcagcctgatgtgcgccgtgctgtgcctgcagctgtacggcctgggcggcacccacggcctgcacaacggcaccgagcacaacaagaccaacgccgtgaccaccagcagcaacagccagagcagcgagagccccgccagaaccgccccccccgtgacccccgacagccccaccgtgacccccaccacccccgccagcgcccccgagggcagcggcgaggcccacagcagcccccccaacaacaccgagggccccagcctgcccgagagcaccagcgagccccccgccgccaccagcaccggcatccccagcgccagcgacgtgaacagcagcacccaggccgccagagacaccagcacccccaccgtgagaaccagcccccccaacagccccagcaccccccccaccccccaggagacccaccaccccgtgagaaacctgctgagcgtgaccagccacaagcccgaggagaccagcgcccccagcgagagcggcaaggagagccccgccgccaacagcccccaccccgtggccagcagaccccccacccccagcaccaccgcccagggccccaccgagaacaacaactacaacaccaccggccagctggagagcctgacccagagcaccaccctgggccccatgaccagcctgacccagaccgacctgccccagagcgtgaccagcatcgccgtgcaggacacccaccccagccccaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccacgccggcctgcccaccgccgagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggcctgaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacatcgacggcaccgtgagactgccccacatccaccacgacggcaccttcatccccggcacctacaagatcgtgatcgacagaaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgaggtggacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaaggtgcccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcggccacggcaagaccatcgagacctaccaggtgagagaggagtacaccagcatctgcctgttcgtgctgggcagcatcctgttcatcgtgagctgcctgatgaagggcctggtgaacagcgtgggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccgtggaggtgagcaacaaggccctgagcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcaagaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcatcaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8646 - RNA, 5070 nt, synthetic construct
  misc_feature 1..5070: note = derived and/or modified CDS sequence (opt4) from CCHFV(K168_40)__KX013457.1__GP
  source 1..5070: mol_type = other RNA
atgcccatcagcaccatgcacatcagcctgatgtgcgccgtgctgtgcctgcagctgtacggcctgggcggcacccacggcctgcacaacggcaccgagcacaacaagaccaacgccgtgaccaccagcagcaacagccagagcagcgagagccccgccagaaccgccccccccgtgacccccgacagccccaccgtgacccccaccacccccgccagcgcccccgagggcagcggcgaggcccacagcagcccccccaacaacaccgagggccccagcctgcccgagagcaccagcgagccccccgccgccaccagcaccggcatccccagcgccagcgacgtgaacagcagcacccaggccgccagagacaccagcacccccaccgtgagaaccagcccccccaacagccccagcaccccccccaccccccaggagacccaccaccccgtgagaaacctgctgagcgtgaccagccacaagcccgaggagaccagcgcccccagcgagagcggcaaggagagccccgccgccaacagcccccaccccgtggccagcagaccccccacccccagcaccaccgcccagggccccaccgagaacaacaactacaacaccaccggccagctggagagcctgacccagagcaccaccctgggccccatgaccagcctgacccagaccgacctgccccagagcgtgaccagcatcgccgtgcaggacacccaccccagccccaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccacgccggcctgcccaccgccgagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacatcgacggcaccgtgagactgccccacatccaccacgacggcaccttcatccccggcacctacaagatcgtgatcgacagaaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgaggtggacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcggccacggcaagaccatcgagacctaccaggtgagagaggagtacaccagcatctgcctgttcgtgctgggcagcatcctgttcatcgtgagctgcctgatgaagggcctggtgaacagcgtgggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccgtggaggtgagcaacaaggccctgagcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacggcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcatcaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8647 - RNA, 5070 nt, synthetic construct
  misc_feature 1..5070: note = derived and/or modified CDS sequence (opt4) from CCHFV(K128_76)__KX013454.1__GP
  source 1..5070: mol_type = other RNA
atgcccatcagcgtgatgcacatcagcctgatgtgcgccgtgctgtgcctgcagctgtacggcctgggcggcacccacggcagccacaacgagaccgagcacaacaagaccaacgccgtgaccaccagcagcgacagccagagccccgagccccccaccagaaccaccctgcccgtgacccccgacagccccaccgtgacccccaccacccccgccagcgcccccgagggcagcggcgaggtgcacaccagcccccccaacaccaccgagggccccagcctgcccgagagcacccccgagccccccaccgccaccagcaccggcatccccagcgccagcgacgtgaacagcagcacccaggccgccagagacaccagcacccccaccgtgcacaccagcccccccaacagccccagcaccccccccaccctgcaggagacccaccaccccatgagaaacctgctgagcgtgaccagccacaagcccgaggagaccagcgcccccagcgagagcggcaaggagagccccgccgccaacagcccccaccccgtggccgacagacccagcaccagcagcaccaccgcccagggccccaccgagaacaacagctacaacaccaccgagcagctggagagcctgacccagagcaccaccctgggccccatgaccagcctgacccagaccgtgctgagccagagcgtgaccagcatcgccgtgcaggacacccacctgagccccaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctggacctggactgcgacgacaccttcttccagaagagaatcgaggagttcttcatcaccggcgagggctacttcaacgaggtgctgcagttcagaacccccggcaccctgagcaccaccgagagcacccacgccggcctgcccaccgccgagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacatcgacggcaccgtgaagctgccccacatccaccacgacggcaccttcatccccggcacctacaagatcgtgatcgacagaaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcagccacggcaagaccatcgagacctaccaggtgagagaggagtacaccagcatctgcctgttcgtgctgggcagcatcctgttcatcgtgagctgcctgatgaagggcctggtgaacagcgtgggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgttcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttccaggacagcatcgtgaagggcatgaagaacctgctgaacagcaccagcctggagaccagcctgagcatcgaggccccctggggcgccatcaacgtgcagagcacctacaagcccgccgtgagcgccgccaacatcgccctgagctggagcagcgtggagcacagaggcagcaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggagaacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8648 - RNA, 5070 nt, synthetic construct
  misc_feature 1..5070: note = derived and/or modified CDS sequence (opt4) from CCHFV(Hodzha)__KX013448.1__GP
  source 1..5070: mol_type = other RNA
atgcccgtgagcatcatgcacatcctgctgatgtgcgccgtgctgtgcctgcagcagtacggcctgggcgagacccacagacccaacaacggcaccgagcacaacaagaccaacgtgctgaccacccccagcgacaagctgagccccgagccccccgtgagcaccgccctgagcgtgacccccgacagcagcaccgtgacccccaccacccccgtgagcggcctggagggcagcggcgaggtgtacaccagcccccccgtgaccaccaagggcctgagccccagcaaggccaccagcgagctgcccgccaccaccggcatcgacaccagcagcgccagcgacgtggacagcagcacccaggccgccagagacaccagcaccctgaccgtgagaaccagcccccccagcagccccagcaccccccccaccagccaggacacctaccacctggtgagaaacctgctgagcgtgaccagccccagacccgaggagaccaccgcccccagcaagagcggcaaggagagccccgtggccaacagcccccaccccgtgaccagcagacccagcagcccccccatcaccgtgcagggccccaccgagaacagcagccacaacaccaccggccagctggagagcatggcccagagcaccaccctggtgcccatggccagccccacccagaccgtgctgagccagagcgtgaccagcctggccgtgcaggacgcccaccccagccccaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcaagacccccagcaccctgagcaccaccgagagcacccacgccgtgagccccaccgccgagcccttcaagagctacttcgccaagggcttcctgagcatcgacagcggctacttcagcgccaagtgctacagcaagaccagcaacagcggcctgcagctgatcaacgtgaccagacacagcaccagaatcgccgacacccccggccccaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacgtggacggcaccgtgagactgccccacatccaccacggcggcaccttcatccccggcacctacaagatcgtgatcgacaagaagaacaagctgaacgacagatgcaccctgtacaccaactgcgtgatcaagggcagagaggtgagaaagggccagagcatcctgagacagtacaagaccgagatcagaatcggcaaggccagcaccggcagcagaagactgctgagcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagaatccccctgctgggcaagatggccatctacatctgcagaatgagcaaccaccccgagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgttcgccgtgagcctgagccccgtgcagagcgcccccatcggccacggcaagaccatcgagacctaccaggccagagaggagtacaccagcatctgcctgttcgtgctgggcagcatcctgttcatcgtgagctgcctgatgaagggcctggtggacagcatcggcaacatcttcttccccggcctgaccatctgcaagacctgcagcatcggcagcatcaacggcttcgagatcgagagccacaagtgctactgcagcctgctgtgctgcccctactgcagacactgccccgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcaagaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgcagcgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcagaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcaagtacaagcacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8649 - RNA, 5070 nt, synthetic construct
  misc_feature 1..5070: note = derived and/or modified CDS sequence (opt4) from CCHFV(Hy13)__AY900145.1__GP
  source 1..5070: mol_type = other RNA
atgagcttcagcatcatgtacacccccctgctgtgcgccgtgctgtgcctgcagctgtggagcctggagggcagccacggcctgagcaacaagacccagcacagcaacaccagcaccaccaaggcccccgaggtgagccaggagttcggcctgcccgtgagcaccgtgagcaccatcaccagcgacccccccagcatcaccagcgccgtgagcgtgagcggcagcgagggcagcggcgacaccaacaccagccccagcgtgaccacccagggcctgaccctgcccgagaccaccctggagctgctgaccaccaccgacaccgacgccagcagcaccgtggtggtggacgtgagcacccagaccgtgaaggacacccccatcagcaccacccacaccagcctgcccagcacccccagcgccaccaccaccccccagggcacccaccacaccgccagaggcctgctgagcgtgaccagcaccaagcccgagggcgccagcacccaggccaaccccgagaagatcagcatggagaccaacagccccagactggccatcagcgagacccccagcttcagccccaccacccaggcccccaccgagaacagcaaccccatcaccagcaagcagctgatcttcagcgcccagcccgtgacccccaaccccgtgaccccccccgtgcagcccgccctgagccagagcgacaccagcaccgccatccaggacatccaccccagccccaccagcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgccgacttcttccagaagagaatcgaggagttcttcctgaccggcgagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaaggtgaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagctggtgatcgacaagaagaacaagcagaacgacagatgcaccctgatcaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgagcagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccatcaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcagcagcatctgcaagacctgcagcatcggcagcatcaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggccaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8650 - RNA, 5070 nt, synthetic construct
  misc_feature 1..5070: note = derived and/or modified CDS sequence (opt4) from CCHFV(SPU415/85)__DQ211635.1__GP
  source 1..5070: mol_type = other RNA
atgcccgtgaacatcatgtacacccccctggtgtgcgccgtgatctgcctgcagctgtggaacctgggcggcaccctggtgttcatcaacagaacccagcacaacgagaccggcaccgtggccacccccgagggcaccctgagacccagactgcccgtgagcaccgccctgcccaccaagagcgacagacccagcgtgggccccgccgccagcagcagcggcctggagggcagcggcgagcccaacaccagccccagcatcaccaccaagggcctgaccccccccgagaccacccccgccctgcccaccgccaccgacaccgacgccagcagcaccggcgtggtggacgtgagcacccagatgaccaaggacatccccatgagcaccgcctacaccaacccccccagcacccccagcgcccccagcaccccccagggcacccaccacaccgccagaggcctgctgagcgtggccagcaccaagagcgaggaggtgagcatgagcaccagccccgccaagaccagcaccgagaccagcagccccccccccgccaccagcgagacccccacccccagccccaccacccaggtgcccaccggcaacaacaaccccaacaccagcagacagcccacccccagcgcccagcccgccatgagcaaccccgccaccagccccgcccagcccaacctgagccagagcgccccccccaccgccgaccagggcgtgcaccccagccccaccaacagaagcaagagaaacctggagatcgagatcatcctgaccctgagccagggcctgagaaagtactacggcaagatcctgaagctgctggacctgaccctggaggaggacaccgagggcctgctggagtggtgcaagagaaacctgggcctgacctgcgacgacaacttcttccagaagagaatcgaggagttcttcctgaccggcgagggctacttcaacgaggtgctgcagttcaaggtgcccagcaccctgagcagcaccgagcccacccacaccagaccccccaccgtggagcccttcaagagctacttcgccaagggcttcctgagcatgaacagcggctacttcagcgccaagtgctaccccagaaccagcaacagcggcctgcagctgatcaacgtgaccaagcacagcgccaagatcgccgacacccccggccccaagatcaccaacctgaagaccatcaactgcatcaacctgagagccagcgtgttcaaggagcacagagaggtggagatcaacgtgctgctgccccaggtggccgtgaacctgagcaactgccacgcccagatcaagagccacgtgtgcgactacagcctggccaccgacggcatggtgagactgccccacatccaccacgagggcaccttcatccccggcacctacaagatcgtgatcgacaagaagaacaagcagaacgacagatgcaccctggtgaccaactgcgtgatcaagggcagagaggtgagaaagggccagagcgccctgagacagtacaagaccgagatcagaatcggcaaggccagcagcggcagcagaagactgctgagcgaggagagcgacggcgactgcatcagcagaacccagctgctgagaaccgagaccaccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcaactgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccatccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggccacggcaagaccatcgagacctaccaggccagagagggctacaccagcttctgcctgttcatcctgggcagcatcctgttcgtggtgagctgcctggtgaagggcctgatcgacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccatcgaggtgagcaacagagccctgctgatcagaaacatcatcaacaccaccttcgtggtgtgcatcctgaccctggccgtgtgcgtggtgagcaccagcgccgtggagatggagagcctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagagagtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgaagatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacaccagaaagtgcgtgaacaccaagctggacagaccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggctga

SEQ ID NO: 8651 - RNA, 5070 nt, synthetic construct
  misc_feature 1..5070: note = derived and/or modified CDS sequence (opt4) from CCHFV(SPU97/85)__DQ211633.1__GP
  source 1..5070: mol_type = other RNA
atgaccgtgaacaccgtgtgcacccccctggtgtgcgccgtgttctgcctgcagctgtggaacctgggcggcaccctggtgcccaccaacagaacccagcacaacaagaccggcaccatggccacccccgagggcaccctgggccccagactgcccgtgagcaccgccctgcccaccaagagcgacagacccagcgtgggccccgccgcccccagcagcggcctggagggcagcggcgagcccaacaccagccccagcatcaccaccaagggcctggccctgcccgagaccacccccgccccccccaccgccaccgacaccgacgccagcagcaccggcgtggtgaacgtgagcacccagatgaccaaggacatccccatgagcaccgcctacaccaacccccccagcacccccagcgcccccagcaccccccagggcacccaccacaccgccagaggcctgctgagcgtggccagcaccaagagcgaggaggtgagcatgagcaccagccccggcaagaccagcaccgagaccagcagccccccccccgccaccagcgagacccccgcccccagccccaccacccaggcccccaccggcaacaacaaccccaacaccagcagacagcccacccccagcgcccagcccgccatgagcaaccccaccaccagccccgcccagcccaacctgctgcagaacgccccccccaccgccgaccagggcgtgcaccccggccccaccaacagaagcaagagaaacctggagatggagatcatcctgaccctgagccagggcctgagaaagtactacggcaagatcctgaagttcctggacctgaccctggaggaggacaccgagggcctgctggagtggtgcaagagaaacctgggcctgacctgcgacgacaacttcttccagaagagaatcgaggagttcttcctgaccggcgagggctacttcaacgaggtgctgcagttcaaggtgcccagcaccctgagcagcaccgagcccacccacaccggcagccccaccgtggagcccttcaagagctacttcgccaagggcttcctgagcatgaacagcggctacttcagcgccaagtgctaccccagaaccagcaacagcggcctgcagctgatcaacgtgaccaagcacagcgccaagatcgccgacacccccggccccaagatcaccaacctgaagaccatcaactgcatcaacctgagagccagcgtgttcaaggagcacagagaggtggagatcaacgtgctgctgccccaggtggccgtgaacctgagcaactgccacgcccagatcaagagccacgtgtgcgactacagcctggccaccgacggcatggtgagactgcccagaatccaccacgagggcaccttcatccccggcacctacaagatcgtgatcgacaagaagaacaagcagaacgacagatgcaccctggtgaccaactgcgtgatcaagggcagagaggtgagaaagggccagagcgccctgagacagtacaagaccgagatcagaatcggcaaggccagcagcggcagcagaagactgctgagcgaggagagcgacggcgactgcatcagcagaacccagctgctgagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcagaatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggccacggcaagaccatcgagacctaccaggccagagagggctacaccagcttctgcctgttcatcctgggcagcatcctgttcatcgtgagctgcctggtgaagggcctgatcgacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccatcgaggtgagcaacagagccctgctgatcagaagcatcatcaacaccaccttcgccgtgtgcatcctgaccctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacacccagaagtgcgtgaacaccaagctggagagaccccagagcatcctgatcgagcacaagggcaccatcatcggcaagcagaacgacacctgcaccgccaaggccagctgctggctggagagcgtgaagagcttcttctacggcctgaagagcatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggctga

SEQ ID NO: 8652 - RNA, 5070 nt, synthetic construct
  misc_feature 1..5070: note = derived and/or modified CDS sequence (opt4) from CCHFV(C-68031)__DQ211629.1__GP
  source 1..5070: mol_type = other RNA
atgagcttcagcatcatgtacacccccctgctgtgcgccgtgctgtgcctgcagctgtggagcctggagggcagccacggcctgagcaacaagacccagcacagcaacaccagcaccaccaaggcccccgaggtgagccaggagttcggcctgcccgtgagcaccgtgagcaccatcaccagcgacccccccagcatcaccagcgccgtgagcgtgagcggcagcgagggcagcggcgacaccaacaccagccccagcgtgaccacccagggcctgaccctgcccgagaccaccctggagctgctgaccaccaccgacaccgacgccagcagcaccgtggtggtggacgtgagcacccagaccgtgaaggacacccccatcagcaccacccacaccagcctgcccagcacccccagcgcccccaccaccccccagggcacccaccacaccgccagaggcctgctgagcgtgaccagcaccaagcccgagggcgccagcacccaggccaaccccgagaagatcagcatggagaccaacagccccagactggccatcagcgagacccccagcttcagccccaccacccaggcccccaccgagaacagcaaccccatcaccagcaagcagctgatcctgagcgcccagcccgtgacccccaaccccgtgaccccccccgtgcagcccgccctgagccagagcgacaccagcaccgccatccaggacatccaccccagccccaccagcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacgacttcttccagaagagaatcgaggagttcttcctgaccggcgagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaaggtgaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagctggtgatcgacaagaagaacaagcagaacgacagatgcaccctgatcaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgagcagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccatcaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcatcaacggcttcgagaccgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8653 - RNA, 5070 nt, synthetic construct
  misc_feature 1..5070: note = derived and/or modified CDS sequence (opt4) from CCHFV(Baghdad 12)__AJ538197.2__GP
  source 1..5070: mol_type = other RNA
atgcccgtgagcatcatgcacatcagcctgatctacgccgtgctgtgcctgcagctgtacggcctgggcgagacccacggcagcagcagcggcaccgagcacaacagaaccaacgtggtggccacccccggcggcagccagagccccgagcccctggtgagcaccaccctgcccgtgaccctggacagcagcaccgtgacccccgccacccaggccagcggccccgagggcagcggcgaggtgtacaccagcccccccaccaccaccgagggcctgagccccagcgacgccaccagcgagctgcccaccaccaccggcatcggcatcagcagcagcagcgacgtgaacagcagcacccaggccgccggcgacaccagcacccccaccgccagaaccagcctgcccgacagccccagcaccccccccaccagccaggacacccaccaccccatgagaaacctgctgagcgtgaccagcctgaagcccgaggagacccccgcccccagcaagagcggcaaggagagccccgccgccagcagcccccaccccgtggccagcagaccccccacccccagcaccaccgcccagggccccaccgagaacaacagcagaaacaccaccgtgcagctgaagagcgtgacccagagcgccaccctgggccccatggccagccccacccagaccgtgctgctgcagagcgtgaccagcatcgccatccaggacacccaccccagccccaccaacagaagcagaagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccacgccggcagccccaccgtggagcccttcaagagctacttcgccaagggcttcctgctgatcgacagcggctacttcagcgccaagtgctacagcagaaccagcaacagcggcctgcagctgatcaacgtgaccagacacagcaccaagatcgccgacacccccggccccaagatcaccaacctgaagaccatcagctgcatcaacctgaaggccagcatcttcaaggagcacagagagatcgagatcaacgtgctgctgccccaggtggccgtgaacctgagcaactgccacgtgaccatcaagagccacgtgtgcgactacagcctgaacatcgacggcaccgtgaagctgccccacatccaccacgagggcatcttcatccccggcacctacaagatcgtgatcgacaagaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgaggagagcggcgacgactgcatcagcagaaccagactgctgagaaccgagaccgccgagatccacggcgacagctacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcaagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctggccgtgagcagcagccccgtgcagagcgcccccatcggctacggcaagaccatcgagacctaccaggccagagagggctacaccagcatctgcctgttcgtgctgggcagcatcctgttcatcgtgagctgcctgaccaagggcctggtggacagcatcggcaacatcttcttccccggcctgagcatctgcaagacctgcagcatcggcagcatcaacggcttcgaggtggagagccacaagtgctactgcagcctgctgtgctgcccctactgcagacactgcagcgccgacagagagatccaccagctgcacctgagcatctgcaagaagagaaagaccggcagcagcgtgatgctggccgtgtgcaagagaatgtgcttcagagccaccatggaggtgagcaacaaggccctgctgatcagaagcatcatcaacaccaccttcgtggtgtgcatcctgaccctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaccaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgacgccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggtgagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacttcttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8654 - RNA, 5070 nt, synthetic construct
  misc_feature 1..5070: note = derived and/or modified CDS sequence (opt4) from CCHFV(Hodzha)__AY223476.1__GP
  source 1..5070: mol_type = other RNA
atgcccgtgagcatcatgcacatcctgctgatgtgcgccgtgctgtgcctgcagcagtacggcctgggcgagacccacagacccaacaacggcaccgagcacaacaagaccaacgtgctgaccacccccggcgacaagctgagccccgagctgcccgtgagcaccgccctgagcgtgacccccgacagcagcaccgtgacccccaccacccccgtgagcggcctggagggcagcggcgacgtgtacaccagcccccccgtgaccaccaagggcctgagccccagcaaggccaccagcgagctgcccgccagcagcggcatcgacaccagcagcgccagcgacgtggacagcagcacccaggccgccagagacaccagcaccctgaccgtgagaaccagcccccccagcagccccagcaccccccccaccagccaggacacctaccacctggtgagaaacctgctgagcgtgaccagcccctggcccgaggagaccaccgcccccagcaagagcggcaaggagagccccgtggccaacagcccccaccccgtgaccagcagacccagcagcccccccatcaccgtgcagggccccaccgagaacagcagccacaacaccaccggccagctggagagcatggcccagagcaccaccctggtgcccatggccagccccacccagaccgtgctgagccagagcgtgaccagcctggccgtgcaggacgcccaccccagccccaccaacagaagcaagagaaacctggagatggtgatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcaagacccccagcaccctgagcaccaccgagagcacccacgccgtgagccccaccgccgagcccttcaagagctacttcgccaagggcttcctgagcatcgacagcggctacttcagcgccaagtgctacagcaagaccagcaacagcggcctgcagctgatcaacgtgaccagacacagcaccagaatcgccgacacccccggccccaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacgtggacggcaccgtgagactgccccacatccaccacggcggcaccttcatccccggcacctacaagatcgtgatcgacaagaagaacaagctgaacgacagatgcaccctgtacaccaactgcgtgatcaagggcagagaggtgagaaagggccagagcatcctgagacagtacaagaccgagatcagaatcggcaaggccagcaccggcagcagaagactgctgagcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagagctgcgagatcgacagcacccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagaatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgttcgccgtgagcctgagccccgtgcagagcgcccccatcggccacggcaagaccatcgagacctaccaggccagagaggactacaccagcatctgcctgttcgtgctgggcagcatcctgttcatcgtgagctgcctgatgaagggcctggtggacagcatcggcaacatcttcttccccggcctgaccatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcaccaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagagaaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcaagtacaagcacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8655 - RNA, 5067 nt, synthetic construct
  misc_feature 1..5067: note = derived and/or modified CDS sequence (opt4) from CCHFV(Kosovo/9553/2001)__AY675511.1__GP
  source 1..5067: mol_type = other RNA
atgcccatcaacatcatgcacaccctgctggtgtgcttcatcctgtacctgcagctgctgggcctgggcggcgcccacggccagagcaacgccaccgagcacaacggcaccaacaccaccaccgcccccggcaccagccagagccccaagccccccgccagcaccacccccagccacgcccccgagagcagcaccatcaagctgaccacccccaccagcgagaccgagggcagcggcgagaccaccccccccaccagcaccacccagggcagcccccccctggagaccacccccgagagaagcaccaccaccgccaccagcaccagcggcaccgacaacatgaacagcaccacccagatgaccgacaacacccccaccctgaccgccagcaccagccccagcagcagccccagcacccccagcaccagccagggcctgcactaccccgtgagaagcctgctgagcgtgagcagccccaagaccgtgaccacccccacccccatgagccccggcgagatgagcagcgagaccagcagccagcacagcgccatgagcagaacccccaccccccacaccgccacccaggtgagcaccgagaacgccaacagaagcaccagcagacagagcgagagcagcgcccagcccgccacccagagccccgtgaccagccccgcccagagcatcctgctgatgagcgccacccccaccaccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcacccccagccccaccgagcccagccacgccagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagatcaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatgcccggcacctacaagatcgtgatcgacagaaagaacaagctgaacgacagatgcaccctggtgaccaactgcgtgatcaagggcagagaggtgagaaagggccagagcgtgctgagacagtacaagaccgagatcaagatcggcaaggcccccaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatcgccagaatgagcaaccaccccaagaccaccatggccttcctgttctggttcagcctgggctacgtgatcacctgcatcctgtgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgaagcagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggccagcaccagcgccgtggagatggagaccctgcccgccgccacctgggagagagaggaggacctgaccaacttctgccaccaggagtgccaggtgcccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcaagagctgcagcgaggacgacaccaagaagtgcgtggacaccaagctggagcagccccagagcatcctgatcgagcacagaggcaccatcatcggcaagcccaacgacacctgccccgccaagaccagctgctggctggagagcgtgaagagcttcttctacggcctgaagaacatgctgggcagcgtgttcggcaacttcttcatcggcatcctgctgttcctggcccccttcttcctgtggatgctgagcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8656 - RNA, 5067 nt, synthetic construct
  misc_feature 1..5067: note = derived and/or modified CDS sequence (opt4) from CCHFV(200406546-Turkey)__KR864902.1__GP
  source 1..5067: mol_type = other RNA
atgcccaccaacatcacccacaccctgctggtgtgcttcatcctgtacctgcagctgctgggcagaggcggcgcccacggccagagcaacgccaccgagcacaacggcaccaacaccaccaccgcccccggcaccagccagagccacaagcccctggtgagcaccacccccccccacaccctggagagcagcaccatcaagcacaccacccccaccagcgagaccgagggcagcggcgagaccacccccccccccaacaccacccagggccccagcccccccgaggccacccccgagagacccgccaccaccgccaccagcacccccagcaccgacaacaccaacagcaccacccagatgaacgacaacaaccccaccagcaccatcagcaccagccccagcagcagccccagcaccccccccaccccccagggcatccaccaccccgccagaagcctgctgagcgtgagcagcctgaagaccgccaccacccccacccccaccagccccggcgagatcagcagcgagaccagcagccagcacagcgccatgagcagaacccccaccctgcacaccaccacccaggtgagcaccgagagcaccaaccacagcacccccagacagagcgagagcagcgcccagcccaccacccccagccccatgaccagccccgcccagagcatcctgcccatgagcgccgcccccaccgccatccagaacatccaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcagctgcgacgacgacttcttccagaagagaatcgaggagttcttcgtgaccggcgagggctacttcaacgaggtgctgcagttcaagaccctgagcaccctgagccccaccgagcccagccacgccaagctgcccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgccgtgatcaagagccacgtgtgcgactacagcctggacaccgacggccccgtgagactgccccacatctaccacgagggcaccttcatccccggcacctacaagatcgtgatcgacaagaagaacaagctgaacgacagatgcatcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctgatcgacctgggctgcccccacgtgcccctgctgggcagaatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagttcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcatcgagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgaccgccagaaagctggagttcggcaccgacagcaccttcaaggccttcagcgccatgcccaagaccagcctgtgcttctacatcgtggagaaggagtactgcaagagctgcaacgaggacgacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacaagagaatcatcgagagactgaacaacaagaagggcaagaacagactgctggacggcgagagactggccgacagaaagatcgccgagctgttcagcaccaagacccacatcggctga

SEQ ID NO: 8657 - RNA, 5067 nt, synthetic construct
  misc_feature 1..5067: note = derived and/or modified CDS sequence (opt4) from CCHFV(Haskovo-V46/13)__KR092379.1__GP
  source 1..5067: mol_type = other RNA
atgcccaccaacatcatgcacaccctgctggtgtgcttcatcctgtacctgcagctgctgggcctgggcggcgcccacggccagagcaacaccaccgagcacaacggcaccaacaacaccaccgcccccggcaccagccagagccccaagccccacatgagcaccacccccccccacgcccccgagagcagcaccatcaagcccaccacccccaccagcgagaccgagggcagcggcgagaccaccccccccagcaacaccacccagggccccagcccccccgagaccaccagcgagagacccgccaccaccgccatcagcaccagcagcaccgacaacatgaaccccaccagccagatgaccgacaacacccccaccagcaccgtgagcatcagccccagcagcagccccagcacccccagcaccccccagggcatgcaccaccccgccagaagcctgctgagcgtgagcagccccaagaccgccaccacccccacccccaccagccccgtggaggtgggcagcgagaccagcagccagcacagcgccatgagcagcacccccaccccccacaccgccacccaggtgagcaccgagaacaccaaccacagcacccccagacagagcgagcccagcgcccagcagaccacccccagccccatgcccagccccgcccagagcaccctgctgatgagcgccgcccccaccgccgtgcagaacacccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccatggagcccagccacgccgagctgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaaggccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagctgggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagaggcaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgcccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgggcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgccatgtgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccggcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccaagctggagcagccccagagcatcctgatcgagcacaagggcaccatcatcggcaagcagaacgacacctgcaccgccagagccagctgctggctggagagcgtgaagagcttcttctacggcctgaagaacatgctgggcagcgtgttcggcaacttcctgatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8658 - RNA, 5067 nt, synthetic construct
  misc_feature 1..5067: note = derived and/or modified CDS sequence (opt4) from CCHFV(VLG/TI29414)__AY179961.1__GP
  source 1..5067: mol_type = other RNA
atgcccaccaacatcatgcacaccctgctggtgtgcttcatcctgtacctgcagctgctgggcctgggcggcgcccacatccagagcaacgccaccgagcacaacggcaccaacaccaccaccgcccccagcaccagccagagccccaagcccctggtgagcaccgcccccccccacgccctggagagcagcaccatcaagcccaccacccccgtgagcgagaccgagggcagcggcggcaccacccccccccccaacaccacccagggccccagcccccccgaggccacccccgagagacccgccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgacatcagcagcgagaccagcagcctgcacagcgccatgagcagaaccagcaccctgtacaccgccacccaggtgagcaccgagaacgccaaccacagcgcccccagacagagcgagagcagcgcccagcagaccaccaccagccccatgaccagccccgcccagcccatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaagcctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagactgagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagagccgagcccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggaacgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccaacctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctgggaggtgggcaccggctgcacctgctgcggctggaacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcatgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtgatcgccgccagcaccagcctgatggccagaaagctggagttcggcaccgacagcaccttcaaggccttcagcgccatgcccaagaccagcctgtgcttctacatcgccgagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8659 - RNA, 5067 nt, synthetic construct
  misc_feature 1..5067: note = derived and/or modified CDS sequence (opt4) from CCHFV(UCCR4405)__KY484029.1__GP
  source 1..5067: mol_type = other RNA
atgcccatcaacatcatgcacgccctgctggtgtgcttcatcctgtacctgcagctgagcggcctgggcggcgcccacagacagagcaacgccaccgagcacaacggcaccaacaccaccaccgcccccggcaccagccagagccccaagccccccgtgagcaccaccctgccccacacccccgaggccagcaccatcaagctgaccacccccaccagcgagaccgagggcagcggcgagaccacccccccccccaacaccacccagggcctgcccctgcccggcaccacccccgagagaagcgccaccaccgccaccagcaccagcagcaccgacgacatgaacagcaccacccagatgaccgacaacacccccaccagcaccgtgagcatcggcctgagcagcagccccagcatgcccagcaccagccagggcatccactaccccgtgagaagcctgctgagcgtgagcagccccaagaccgccaccacccccacccccatgagccccggcgaggtgagccccgagaccagcagccagcacagcgccatgagcagaatccccaccctgtacaccgccacccaggtgagcaccgagaacaccaacagaagcatccccagacagagcgagagcagcgtgcagcccgccacccagagccccatcaccagccccgcccagaccatcctgctgatgagcgccgcccccaccgccatccaggacatgcaccccagccccaagaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagacccccagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcgccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactacagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgatcctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcaactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggtgtgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcatcttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8660 - RNA, 5067 nt, synthetic construct
  misc_feature 1..5067: note = derived and/or modified CDS sequence (opt4) from CCHFV(Ast133)__KX056060.1__GP
  source 1..5067: mol_type = other RNA
atgcccatcaacatcaagcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccacccccccccacacccccgagagcagcaccgtgaagctgaccacccccaccagcgagaccgagggcagcggcgagaccacccccccccccaacaccacccagggcctgcccctgcccggcaccacccccgagagaagcgccaccaccgccaccagcaccagcagcaccgacaacatgaacagcaccacccaggtgaccgacaacacccccaccagcaccgtgagcatcagccccagcagcagccccagcatgcccagcaccagccagggcatccaccaccccgtgagaagcctgctgagcgtgagcagccccaagaccgtgaccacccccacccccatgagccccggcgagatgagccccgagaccagcagccagcacttcgccatgagcagaatccccaccctgtacaccgccacccaggtgagcaccgagaacaccgacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacagaaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccgacgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacctgctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcagcaagacccacatcggctga

SEQ ID NO: 8661 - RNA, 5067 nt, synthetic construct
  misc_feature 1..5067: note = derived and/or modified CDS sequence (opt4) from CCHFV(Ast137)__KX056057.1__GP
  source 1..5067: mol_type = other RNA
atgcccatcaacatcatgcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccccccccggcaccacccccgagagacccgccaccaccgccaccagcaccagcagcaccgacaacatgaacagcaccacccaggtgaccgacaacacccccaccagcaccgtgagcatcagccccagcagcagccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccgcccaggtgagcaccgagaacaccaacagaagcacccccagacagagcgagagcagcgcccagcccgccacccagagccccaccaccttccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatccacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctacctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaccaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggctga

SEQ ID NO: 8662 - RNA, 5067 nt, synthetic construct
  misc_feature 1..5067: note = derived and/or modified CDS sequence (opt4) from CCHFV(Ast149)__KX056054.1__GP
  source 1..5067: mol_type = other RNA
atgcccatcaacatcatgcacaccctgctggtgtgcttcatcctgtacctgcagctgagcggcctgggcggcgcccacggccagagcaacgccaccgagcacaacggcaccaacaccaccaccgcccccggcaccagccagagccccaagccccccgccagcaccacccccccccacacccccgagagcagcaccgtgaagctgaccacccccaccagcgagaccgagggcagcggcgagaccacccccccccccaacaccacccagggcctgcccccccccggcaccacccccgagagacccgccaccaccgccaccagcaccagcagcaccgacaacatgaacagcaccacccaggtgaccgacaacacccccaccagcaccgtgagcaccagccccagcagcagccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccgcccaggtgagcaccgagaacgccaacagaagcacccccagacagagcgagagcagcgcccagcccgccacccagagccccaccaccttccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatctacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgcccatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggccctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggctga

SEQ ID NO: 8663 - RNA, 5067 nt, synthetic construct
  misc_feature 1..5067: note = derived and/or modified CDS sequence (opt4) from CCHFV(Ast199)__KX056051.1__GP
  source 1..5067: mol_type = other RNA
atgcccatcaacatcatgcacaccctgctggtgtgcttcatcctgtacctgcagctgagcggcctgggcggcgcccacgtgcagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccccccccggcaccacccccgagagacccgccaccaccgccaccaccaccagcagcaccgacaacatgaacagcaccacccaggtgaccgacaacacccccaccagcaccgtgagcatcagccccagcagcaaccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccgcccaggtgagcaccgagaacaccaacagaagcacccccagacagagcgagagcagcgcccagcccgccacccagagccccaccaccttccccgcccagaccatccccctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagacccccagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagatgcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggctga

SEQ ID NO: 8664 - RNA, 5067 nt, synthetic construct
  misc_feature 1..5067: note = derived and/or modified CDS sequence (opt4) from CCHFV(Saf)__KX013487.1__GP
  source 1..5067: mol_type = other RNA
atgcccaccaacatcatgcacaccctgctggtgtgcttcatcctgtacctgcagctgctgggcctgggcggcgcccacggccagagcaacgccaccgagcacaacggcaccaacaccaccaccgcccccagcaccagccagagccccaagcccctggtgagcaccgcccccccccacgccctggagagcagcaccatcaagcccaccacccccgccagcgagaccgagggcagcggcgagaccacccccccccccaacaccacccagggccccagcccccccgagaccacccccgagagacccgccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgagatcagcagcgagaccagcagcctgcacagcgccatgagcagaaccagcaccctgtacaccgccacccaggtgagcaccgagaacgccaaccacagcgcccccagacagagcgagagcagcgcccagcccaccaccaccagccccatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatccaccacgagggcaccttcatccccggcacctacaagatcgtgatcgacaaggagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcactacctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacatgaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgtgagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8665 - RNA, 5067 nt, synthetic construct
  misc_feature 1..5067: note = derived and/or modified CDS sequence (opt4) from CCHFV(Min)__KX013481.1__GP
  source 1..5067: mol_type = other RNA
atgcccaccaacatcatgcacaccctgctggtgtgcttcatcctgtacctgcagctgctgggcctgggcggcgcccacggccagagcaacgccaccgagcacaacggcaccaacaccaccaccgcccccagcaccagccagagccccaagcccctggtgagcaccgcccccccccacgccctggagagcagcaccatcaagcccaccacccccgccagcgagaccgagggcagcggcgagaccacccccccccccaacaccacccagggccccagcccccccgagaccacccccgagagacccgccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagcctgaagaccgccaccacccccacccccaccagccccggcgagatcagcagcgagaccagcagcctgcacagcgccatgagcagaaccagcaccctgtacaccgccacccaggtgagcaccgagaacgccaaccacagcgcccccagacagagcgagagcagcgcccagcccaccaccaccagccccatgaccagccccgcccagagcatcctggtgatgagcgccgcccccatcgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcaccatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaccaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8666 - RNA, 5067 nt, synthetic construct
  misc_feature 1..5067: note = derived and/or modified CDS sequence (opt4) from CCHFV(Mamon)__KX013478.1__GP
  source 1..5067: mol_type = other RNA
atgcccaccaacatcatgcacaccctgctggtgtgcttcatcctgtacctgcagctgctgggcctgggcggcgcccacggccagagcaacaccaccgagcacaacggcaccaacaccaccaccgcccccagcaccagccagagccccaagcccctggtgagcaccgcccccccccacgccctggagagcagcaccatcaagcccaccacccccgccagcgagaccgagggcagcggcgagaccacccccccccccaacatcacccagggccccagcccccccgagaccacccccgagagacccgccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgagatcagcagcaagaccagcagcctgcacagcgccatgagcagaaccagcaccctgtacaccgccacccaggtgagcaccgagaacgccaaccacagcgcccccagacagagcgagagcagcgcccagcccaccaccaccagccccatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgagcgacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccgtggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaagaccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8667 - RNA, 5067 nt, synthetic construct
  misc_feature 1..5067: note = derived and/or modified CDS sequence (opt4) from CCHFV(K340_6)__KX013475.1__GP
  source 1..5067: mol_type = other RNA
atgcccatcaacatcatgcacaccctgctggtgtgcttcatcctgtacctgcagctgagcggcctgggcggcgcccacgtgcagagcaacgccaccgagcacaacggcaccaacaccaccaccgcccccggcaccagccagagccccaagccccccgccagcaccaccctgccccacacccccgagagcagcaccgtgaagcccaccacccccaccagcgagaccgagggcagcggcgagaccacccccccccccaacaccacccagggcctgccccccaccggcaccacccccgagagaagcgccaccaccgccaccagcaccagcagcaccgacaacatgaacagcaccacccaggtgaccgacagcacccccaccagcaccgtgagcaccagccccagcagcagcagcagcatgcccagcaccagccagggcatccaccaccccgtgagaagcctgctgagcgtgagcagccccaagaccgtgaccacccccacccccatgagccccggcgagatgagccccgagaccagcagccagcacagcgccatgagcagagtgcccaccctgtacaccgccacccaggtgagcaccgagaacaccgacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacagaaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcaccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatcccccccctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgagcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtgaccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacttcaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8668 - RNA, 5067 nt, synthetic construct
  misc_feature 1..5067: note = derived and/or modified CDS sequence (opt4) from CCHFV(K323_27)__KX013472.1__GP
  source 1..5067: mol_type = other RNA
atgcccatcaacatcatgcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccctgcccggcaccacccccgagagaagcgccaccaccgccaccagcaccagcagcaccgacaacatgaacagcaccacccaggtgaccgacaacacccccaccagcaccgtgagcatcagccccagcagcagccccagcatgcccagcaccagccagggcatccaccaccccgtgagaagcctgctgagcgtgagcagccccaagaccgtgaccacccccacccccatgagccccggcgagatgagccccgagaccagcagccagcacagcgccatgagcagaatccccaccctgtacaccgccacccaggtgagcaccgagaacaccgacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagagcagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcagcagccacgtgtgcgactacagcctggacaccgacggccccgtgagactgcccagaatccaccacgagggcaccttcatccccggcacctacaagatcgtgatcgacagaaaggacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacctgctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgaccgtgctgctggtgctgctgaccgtgagcctgagccccgtgcagagcgcccccgtgggccacggcaacaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccccactgcagacacagaagcgccgacagagagatccaccagctgcacctgagcatctgcaagaagagaaagaccggcagcaacgtgatgctggccgtgtgcaagagaatgtgccccaaggccaccatcgaggccagcagaagagccctgcccatcagaagcatcatcaacaccaccctggtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccggccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaacgacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8669 - RNA, 5067 nt, synthetic construct
  misc_feature 1..5067: note = derived and/or modified CDS sequence (opt4) from CCHFV(K315_14)__KX013469.1__GP
  source 1..5067: mol_type = other RNA
atgcccttcaacatcatgcacaccctgctggtgtgcttcatcctgtacctgcagctgagcggcctgggcggcgcccacggccagagcaacgagaccgagcacaacggcaccaacaccaccaccgtgcccggcaccagccagagccccaagccccccgccagcaccaccctgcagcacacccccgagagcagcaccgtgaagctgaccacccccaccagcgagaccgagggcagcggcgagaccacccccccccccaacaccacccagggcctgcccccccccggcaccacccccgagagaagcgccaccaccgccaccagcaccagcagcaccgacaacatgaacagcaccacccaggtgaccgacaacacccccaccagcaccgtgagcatcagccccagcagcagccccagcatgcccagcaccagccagggcatccactaccccatcagaagcctgctgagcgtgagcagccccaagaccgtgaccacccccacccccatcagccccggcgagatgagccccgagaccagcagccagcacagcgccatgagcagaatccccaccctgtacaccgccacccaggtgagcaccgagaacaccaacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcagaatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccgtggtggaccagagactgggcagcgagctgggctgctacaccatcaacagagtgaagagcttcaagctgtgcaagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgagggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtgtacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaagctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8670 - RNA, 5067 nt, synthetic construct
  misc_feature 1..5067: note = derived and/or modified CDS sequence (opt4) from CCHFV(K229_243)__KX013466.1__GP
  source 1..5067: mol_type = other RNA
atgcccaccaacatcatgcacaccctgctggtgtgcttcatcctgtacctgcagctgctgggcctgggcggcgcccagggccagagcaacgccaccgagcacaacgagaccaacaccaccaccgcccccagcaccagccagagccccaagccccccgtgagcaccacccccccccacgccctggagagcagcaccatcaagcccaccacccccgccagagagaccgagggcagcggcgagaccacccccccccccaacaccacccagggccccagcccccccgaggccacccccgagagacccgccaccaccgccaccagcacccccagcaccgacaacaccaacagcaccacccacgtgaccgacaacaaccccaccagcaccatcagcaccagccccagcagcagccccagcacccccttcaccccccagggcatccaccaccccgccagaaacctgctgagcgtgagcagccccaagaccgccaccacccccacccccaccagccccagagagctgagcagcgagaccagcagcctgcacagcgccatcagcagaaccagcaccctgtacaccgccacccaggtgagcaccgagaacgccaaccacagcgcccccagacagagcgagagcagcgcccagcccaccaccaccagccccatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccgccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctgacccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8671 - RNA, 5067 nt, synthetic construct
  misc_feature 1..5067: note = derived and/or modified CDS sequence (opt4) from CCHFV(K229_194)__KX013463.1__GP
  source 1..5067: mol_type = other RNA
atgcccatcaacatcatgcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccccccccggcaccacccccgagagacccgccaccaccgccaccagcaccagcagcaccgacaacatgaacagcaccacccaggtgaccgacaacacccccatcagcaccgtgagcatcagccccagcagcagccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccacccaggtgagcaccgagaacaccaacagaagcacccccagacagagcgagagcagcgcccagcccgccacccagagccccaccaccagccccacccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgaacaccctgagccccaccgagcccagccacgtgagactgcccaccgccgagcccttcaagagctacttcgccaagggcttcctgagcgtggacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaagggcaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccagcttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacagctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggctga

SEQ ID NO: 8672 - RNA, 5067 nt, synthetic construct
  misc_feature 1..5067: note = derived and/or modified CDS sequence (opt4) from CCHFV(Gaib)__KX013445.1__GP
  source 1..5067: mol_type = other RNA
atgcccgtgagcatcatgtacatccccctggtgtacgccgtgatctacctgcagctgtacggcctgggcggcgcccacggcctgctgaacaagaccgagcagaacgagaccggcatcaccgccacccacggcagagtgcagggcccccccagcgccagcatcaccctgcccgtgacccccgaccccctgagcgccaccagcgccgccagcaccagcggccccgagggcagcggcgaggtgcccaccagccccagcaccatcacccagggcctgaccagcagcgagaacaccccccagctgcccaccgccaccgacaccggcatcagcagcaccagcatcatcgacgtgagcacccagaccgccggcgacaccagcacccccaccgcccacaccagcctgcccaacagccccagcgcccccttcaccagccaggacaccagacacaccgtgagaggcctgctgaccgtgaccagcaccaagagcgacgaggccagcaccctgaccgaccccaaggaggccagcaccgaggccagaagccccagccccagcatcagcagaacccccacccccagccccaccgtgcaggccagcaccgagaacaacacccccagcacccccagacagcccgagcccaccaccagacccgccctgcccagccccaccaccagccccacccagcccagcctgagccagagcgccaccagcgccgccatccaggacatgcaccccagccccaccaacagaagcagaagaaacctggagatggagatcatcctgaccctgagccagggcctgaagaagtactacggcaagatcctgaagctgctggacctgaccctggaggaggacaccgagggcctgctggagtggtgcaagagaaacctggacctgacctgcgacgagaacttcttcctgaagagaatcgaggagttcttcctgagcggcgagggccacttcaacgaggtgctgcagttcaaggcccccagcaccatgagcagcaccgagcccacccacgccggcccccccaccgtggagcccttcaagagctacttcgccaagggcttcctgagcatcgacagcggctacttcagcgccaagtgctaccccagaaccagcaacagcggcctgcagctgatcaacgtgacccagcacaccgccagaatcgccgacacccccggccccaagatcaccaacgtgaagaccatcaactgcatcaacctgaaggccagcgtgttcaagaagcacagagaggtggagatcaacgtgctgctgccccagatcgccgtgaacctgagcaactgccacgtgctgatcaagagccacgtgtgcgactacagcctgaacttcgacggcatggtgagactgcccagaatccaccacgagggcaccttcatccccggcacctacaagatcgtgatcgacagaaagaacaagcagaacgacagatgcaccctggtgaccaactgcgtgatcaagggcagagaggtgagaaagggccagagcgccctgagacagtacagaaccgagatcaagatcggcgaggccagcatcggcagcagaagactgctgagcgaggagagcagcgacgactgcatcagcagaacccagctgctgagaaccgagaccgccgagatccacaacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcatccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcttctgcaaggccatcttctacctgctgatcatcgtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtggtgcactgccccaagagaaaggagaagatcgaggagaccgagctgtacctgaacctggagagagtgccctgggtggtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacaccagcatctgcctgttcgtgctgggcggcatcctgttcatcgtgagctgcctgatgaagggcctggtggacagcgtgggcaacaacttcttccccggcctgaccatctgcaagacctgcagcatcagcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcctgagagtgaccaccgaggtgagcaacagagccctgttcatcagaagcatcatcaacaccaccttcgtgatctgcatcctgatcctggccgtgtgcgtgatcagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcatcgagcacagaggcaacaagatcctggtgagcggcagaagcgagagcatcatgaagctggaggagagaaccggcatcagctgggacctgggcgtggaggacgccagcgagagcagactgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcagagaggacacccagaagtgcgtgagcaccaagctggagcagccccagagcatcctgatcgagcacaagggcaccatcatcggcaagcagaacaacacctgcaccaccaagaccacctgctggctggagagcgtgaagagcttcttctacggcctgaagaacatgctgagcagcatcttcggcaacgtgttcgtgggcatcttcagcttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagagcaagctgctggacggcgagagactggccgacagaaagatcgccgagctgttcagcaccaagacccacatcggctga

SEQ ID NO: 8673 - RNA, 5067 nt, synthetic construct
  misc_feature 1..5067: note = derived and/or modified CDS sequence (opt4) from CCHFV(Kosova Hoti)__EU037902.1__GP
  source 1..5067: mol_type = other RNA
atgcccatcaacatcatgcacaccctgctggtgtgcttcatcctgtacctgcagctgctgggcctgggcggcgcccacggccagagcaacgccaccgagcacaacggcaccaacaccaccaccgcccccggcaccagccagagccccaagccccccgccagcaccacccccagccacgcccccgagcccagcaccatcaagctgaccacccccaccagcgagaccgagggcagcggcgagaccaccccccccaccaacaccacccaggacagcccccccctggagaccacccccgagagaagcgccaccaccgccaccagcaccagcggcaccgacaacatgaacagcaccacccagatgaccgacaacacccccaccagcaccgtgagcaccagcctgagcagcagccccagcacccccagcaccagccagggcatgcaccaccccgtgagaagcctgctgagcgtgagcagccccaagaccgccaccacccccacccccatgagccccggcgagatgagcagcgagaccagcagccagcacagcgccatgagcagaacccccaccccccacaccgccacccaggtgagcaccgagaacgccaacagaagcaccagcagacagagcgagagcagcgcccagcccgccacccagagccccgtgaccagccccgcccagagcatcctgctgatgagcgccacccccaccaccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcacccccagcagcaccgagcccagccacgccagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatgcccggcacctacaagatcgtgatcgacagaaagaacaagctgaacgacagatgcaccctggtgaccaactgcgtgatcaagggcagagaggtgagaaagggccagagcgtgctgagacagtacaagaccgagatcaagatcggcaaggcccccaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccagaagggcagaggccacgtgaagctgagcagaggcagcgaggtggtgctggacgcctgcgacagcaactgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccaagaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgaagcagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgaacatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgcccccagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccggcaccagcctgatggccagaaagctggagttcggcaccgacagcaccttcaaggccttcagcgccatgcccaagaccagcctgtgcttctacatcgtggagaaggagtactgcaagagctgcagcgaggacgacaccaagaagtgcgtggacaccaagctggagcagccccagagcatcctgatcgagcacagaggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8674 - RNA, 5067 nt, synthetic construct
  misc_feature 1..5067: note = derived and/or modified CDS sequence (opt4) from CCHFV(Turkey200310849)__DQ211636.1__GP
  source 1..5067: mol_type = other RNA
atgcccaccaacatcatgcacaccctgctggtgtgcttcatcctgtacctgcagctgctgtgcctgggcggcgcccacggccagctgaacaccaccgagcacaacggcaccaacaacaccaccgcccccggcgccagccagagccccaagccccccatgagcaccacccccccccacgcccccgagagcagcaccatcaagcccaccacccccatcagcgaggccgagggcagcggcgagaccaccagcacccccaacaccacccagggcctgagcagccccgagaccaccagcgagagacccgccaccaccgccatcagcaccagcagcaccgacagcaccaaccccaccacccagatgaccgacaacacccccaccctgaccgtgagcaccagccccagcagcagccccagcacccccagcaccccccagggcatctaccaccccgccagaagcctgctgagcgtgagcagccccaagaccgtgaccacccccacccccaccagccccggcgagatgagcagcgagaccagcagccagcacagcgccatgagcagaatccccaccccccacaccgccaccagagtgagcaccgagaacaccaaccacagcacccccagacagagcgagagcagcgcccagcagaccacccccagccccatgaccagccccgcccagagcatcctgctgatgagcgccgcccccaccgccgtgcaggacatccaccccagccccaccaacagaagcaagagaaacctggagaccgagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagactgcccaccgccgagcccttcaagagctacttcgccaagggcttcctgagcatcgacagcggctacttcagcgccaagtgctaccccagaagcagcgccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcttcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcagctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagatctaccagaccagagagggcttcgccagcatctgcctgttcatgctgggcagcatcctgttcatcgtgagctgcctggtgaagggcctggtggacagcgtgagcgacagcttcttccccggcctgagcgtgtgcaagacctgcagcatcggcagcgtgaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccgccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggctga

SEQ ID NO: 8675 - RNA, 5067 nt, synthetic construct
  misc_feature 1..5067: note = derived and/or modified CDS sequence (opt4) from CCHFV(Kashmanov)__DQ211631.1__GP
  source 1..5067: mol_type = other RNA
atgcccaccaacatcatgcacaccctgctggtgtgcttcatcctgtacctgcagctgctgggcctgggcggcgcccacggccagagcaacgccaccgagcacaacggcaccaacaccaccaccgcccccagcaccagccagagccccaagcccctggtgagcaccgcccccccccacgccctggagagcagcaccatcaagcccaccacccccgccagcgagaccgagggcagcggcgagaccacccccccccccaacaccacccagggccccagcccccccgagaccacccccgagagacccgccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgagatcagcagcgaggccagcagcctgcacagcgccatgagcagaaccagcaccctgtacaccgccacccaggtgagcaccgagaacgccaaccacagcgcccccagacagagcgagagcagcgcccagcccaccaccaccagccccatgaccagccccgcccagagcatcctggtgatgagcgccgcccccatcgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccggcccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcaccatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacagcctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8676 - RNA, 5067 nt, synthetic construct
  misc_feature 1..5067: note = derived and/or modified CDS sequence (opt4) from CCHFV(Drosdov)__DQ211630.1__GP
  source 1..5067: mol_type = other RNA
atgcccatcaacatcatgcacgccctgctggtgtgcttcatcctgtacctgcagctgagcggcctgggcggcgcccacagacagagcaacgccaccgagcacaacggcaccaacaccaccaccgcccccggcaccagccagagccccaagccccccgtgagcaccaccctgccccacacccccgaggccagcaccatcaagctgaccacccccaccagcgagaccgagggcagcggcgagaccacccccccccccaacaccacccagggcctgcccctgcccggcaccacccccgagagaagcgccaccaccgccaccagcaccagcagcaccgacgacatgaacagcaccacccagatgaccgacaacacccccaccagcaccgtgagcatcggcctgagcagcagccccagcatgcccagcaccagccagggcatccactaccccgtgagaagcctgctgagcgtgagcagccccaagaccgccaccacccccacccccatgagccccggcgaggtgagccccgagaccagcagccagcacagcgccatgagcagaatccccaccctgtacaccgccacccaggtgagcaccgagaacaccaacagaagcatccccagacagagcgagagcagcgtgcagcccgccacccagagccccatcaccagccccgcccagaccatcctgctgatgagcgccgcccccaccgccatccaggacatgcaccccagccccaagaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagacccccagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcgccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactacagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgatcctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatgaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcaactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggtgtgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcatcttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8677 - RNA, 5067 nt, synthetic construct
  misc_feature 1..5067: note = derived and/or modified CDS sequence (opt4) from CCHFV(1231-CR/TI-2015)__KU161585.1__GP
  source 1..5067: mol_type = other RNA
atgcccatcaacatcatgcacaccctgctggtgtgcttcatcctgtacctgcagctgctgggcctgggcggcgcccacgagcagagcaacgccaccgaccacaacagaaccaacaccatcaccgcccccagcaccagccagaaccccaagccccccgccagcaccacccccccccacacccccgagagcagcaccatcaagctgatcaccagcaccggcgaggccgagggcagcggcgagaccaccccccccctgaacaccacccagggccccttcccccccgagaccaccagcgagcaccccgccagcaccgccaccaacaccagcagcaccaacagcatgaacagcaccacccagatgaccgacaagaccctgaccagcaccgtgagcaccagcctgagcatcagccccagcacccccagcaccagccagggcatccactaccccatcagaagcctgctgagcgtgagcagccccagaaccgccgccacccccacccccatgagcaccagagagatgagcagcgagaccaacagccagcacagcgccgtgagcagaacccccaccttccacaccgccacccaggtgagcaccgagaacgacaacagaagcacccccagacagagcgagagcagcgcccagcccgccacccagagccccatgaccagccccgcccagagcatcctgctggtgagcgccgcccccaccaccatccagaacatccaccccagccccaccaacagaagcaagagaaacctggagatggagatcatcctgaccctgccccagggcctgaagaagtactacggcaagatcctgaagctgctgcacctgaccctggaggaggacaccgagggcctgctggagtggtgcaagagaaacctgggcagcaactgcgacgacgagttcttccagaagagaatcgaggagttcttcatcaccggcgagggctacttcaacgaggtgctgcagttcaagaccctgagcaccctgagccccatggagcccagccacgccagaccccccaccgccgagcccttcaagagctacttcgccaagggcttcctgagcatcgacagcggctacttcagcgccaagtgctaccccagaagcagcagcagcggcctgcagctgatcaacatcacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatccccggcacctacaagatcgtgatcgacaagaagaacaagctgaacgacagatgcaccctggtgaccaactgcgtgaccaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggagagcgtgagcgacagcttcttccccggcctgagcgtgtgcagaacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8678 - RNA, 5067 nt, synthetic construct
  misc_feature 1..5067: note = derived and/or modified CDS sequence (opt4) from CCHFV(1-CR/HU-2015)__KU161584.1__GP
  source 1..5067: mol_type = other RNA
atgcccatcaacatcatgcacaccctgctggtgtgcttcatcctgtacctgcagctgctgggcctgggcggcgcccacgagcagagcaacgccaccgaccacaacagaaccaacaccatcaccgcccccagcaccagccagaaccccaagccccccgccagcaccacccccccccacacccccgagagcagcaccatcaagctgatcaccagcaccggcgaggccgagggcagcggcgagaccaccccccccctgaacaccacccagggccccttcccccccgagaccaccagcgagcaccccgccagcaccgccaccaacaccagcagcaccaacagcatgaacagcaccacccagatgaccgacaacaccctgaccagcaccgtgagcaccagcctgagcatcagccccagcacccccagcaccagccagggcatccactaccccgtgagaagcctgctgagcgtgagcagccccaagaccgccgccacccccacccccatgagcaccagagagatgagcagcgagaccagcagccagcacagcgccatgagcagaacccccaccttccacaccgccacccaggtgagcaccgagaacgccaacagaagcacccccagacagagcgagagcagcgcccagcccgccacccagagccccatgaccagccccgcccagagcatcttcctggtgagcgccgcccccaccaccatccagaacatccaccccagccccaccaacagaagcaagagaaacctggagatggagatcatcctgaccctgccccagggcctgaagaagtactacggcaagatcctgaagctgctgcacctgaccctggaggaggacaccgagggcctgctggagtggtgcaagagaaacctgggcagcaactgcgacgacgagttcttccagaagagaatcgaggagttcttcatcaccggcgagggctacttcaacgaggtgctgcagttcaagaccctgagcaccctgagccccaccgagcccagccacgccagaccccccaccgccgagcccttcaagagctacttcgccaagggcttcctgagcatcgacagcggctacttcagcgccaagtgctaccccagaagcagcaccagcggcctgcagctgatcaacatcacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcagaacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8679 - RNA, 5067 nt, synthetic construct
  misc_feature 1..5067: note = derived and/or modified CDS sequence (opt4) from CCHFV(V42/81)__GU477490.1__GP
  source 1..5067: mol_type = other RNA
atgcccaccaacaccatgcacaccctgctggtgtgcttcatcctgtacctgcagctgctgggcctgggcggcgcccacgtgcagcccaacgccaccgagcacaacagaaccaacaccaccaccgcccccggcaccagccacagcctgaagcccctggtgagcaccacccccccccaggcccccgagagcagcaccatcaagcccaccacccccaccagcgagaccgagggcagcggcgaggccacccccctgagcaacaccatccaggcccccagcagccccgagaccaccagcgagagacccgccaccgccgtgatcagcaccagcggcaccgacagcaccaacagcaccacccagaccaccgacaacaaccccaccaccaccgtgggcaccagccccagcagcagccccagcacccccagcaccccccagggcatccaccaccacgccagaagcctgctgagcgtgaccagccccgagaccgtgaccacccccaagcccaccagccccagagagatgagcagcgagaccagcaaccagcacagcgccatgagcagaacccccacccaccacaccgtgacccaggtgagcaccgagaacaccagccacagcacccccagacagcccgagagcagcgcccagcccaccagcagcagccccatgaccagccccgcccagagcaccctgctgatgagcgccgcccccaccgccgtgcagagcatccaccccagccccaccaacagaagcaagagaaacctggagaccgagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagacccccagcaccgtgagccccaccgagcccagccacgccagactgcccaccgccgagcccttcaagagctacttcgccaagggcttcctgagcatcgacagcggctacttcagcgccaagtgctacagcagaagcagcaccagcggcctgcagctgatcaacgtgacccagcaccccgccagaatcgccgagacccccggccccaagaccaccagcctgaagaccatcaactgcatcaacctgagagccagcgtgttcaaggagaacagagagatcgagatcagcgtgctgctgccccagatcgccgtgaacctgagcaactgccacgtggtgatcaacagccacgtgtgcgactacagcctggacaccgacggccccgtgagactgcccagaatcaaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcaaggagcccggcgacgactgcatcagcagaacccagctgatgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaaggcctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctggagtgcccccacatccccctgctgggcaagctggccatctacatctgcagaatgagcaaccaccccagaaccaccatggccttcctgttctggttcggcttcggctacgtgatcacctgcatcctgtgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggtgctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcatcgtgaagggcctggtggacagcgtgagcgacagcttcttccccggcctgagcgtgtgcaagacctgcagcatcagcagcatcaacggcttcgagatcgagagccacaagtgctactgcagcctgttctgctgcccctactgcagacactgcagcgccgacagagagatccaccagctgcacctgagcatctgcagaaagagaagaaccggcagcaacgtgatgctggccgtgtgcaagagaatgtgcttcagagccaccatcgaggtgagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacatccagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcatcgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgagaccccccagctggacctgaaggccagacccgcctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagagcggcaccgacagcaccttcaaggccttcagcgccatgcccaagaccagcctgtgcttctacatcgtggagagagagtactgcaagagctgcagcgaggacgacacccagaagtgcgtggagaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggaggacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8680 - RNA, 5067 nt, synthetic construct
  misc_feature 1..5067: note = derived and/or modified CDS sequence (opt4) from CCHFV(ROS/HUVLV-100)__DQ206448.1__GP
  source 1..5067: mol_type = other RNA
atgcccaccaacatcatgcacaccctgctggtgtgcttcatcctgtacctgcagctgctgggcctgggcggcgcccacagacagagcaacgccaccgagcacaacggcaccaacaccaccaccgcccccagcaccagccagagccccaagcccctggtgagcaccgcccccccccacgccctggagagcagcaccatcaagcccaccacccccgtgagcgagaccgagggcagcggcgagaccacccccccccccaacaccacccagggccccagcccccccgaggccacccccgagagacccaccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgagatcagcagcgagaccagcagcctgcacagcgccatgagcagaaccagcaccctgtacaccgccacccaggtgagcaccgagaacgccaaccacagcgcccccagacagagcgagagcagcgcccagcagaccaccaccagccccatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagactgagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8681 - RNA, 5067 nt, synthetic construct
  misc_feature 1..5067: note = derived and/or modified CDS sequence (opt4) from CCHFV(5180-R-2011)__KR814874.1__GP
  source 1..5067: mol_type = other RNA
atgcccaccaacatcatgcacaccctgctggtgtgcttcatcctgtacctgcagctgctgggcctgggcggcgcccacagacagagcaacgccaccgagcacaacggcaccaacaccaccaccgcccccagcaccagccagagccccaagccccccgtgagcaccgcccccccctacgcccccgagagcagcaccatcaagcccaccacccccgccagcgagaccgagggcagcggcgagaccacccccccccccaacaccacccagggccccagcccccccgaggccacccccgagagacccgccaccaccgccaccagcacccccagcaccgacaacaccaacagcaccacccacgccaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgacatcagcagcgagaccagcagcctgcacagcgccatgagcagaacccccaccctgcacaccgccacccaggccagcaccgagaacgccaaccacagcgcccccagacagagcgagagcagcgcccagcagaccaccaccagccccatgaccagccccgcccagcccatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagactgagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagagatcagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcgtgtgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8682 - RNA, 5067 nt, synthetic construct
  misc_feature 1..5067: note = derived and/or modified CDS sequence (opt4) from CCHFV(5170-R-2011)__KR814873.1__GP
  source 1..5067: mol_type = other RNA
atgcccttcaacatcatgcacaccctgctggtgtgcttcatcctgtacctgcagctgagcggcctgggcggcgcccacggccagagcaacgagaccgagcacaacggcaccaacaccaccaccgtgcccggcaccagccagagccccaagccccccgccagcaccaccctgcagcacacccccgagagcagcaccgtgaagctgaccacccccaccagcgagaccgagggcagcggcgagaccacccccccccccaacaccacccagggcctgcccccccccggcaccacccccgagagaagcgccaccaccgccaccagcaccagcagcaccgacaacatgaacagcaccacccaggtgaccgacaacacccccaccagcaccgtgagcatcagccccagcagcagccccagcatgcccagcaccagccagggcatccactaccccatcagaagcctgctgagcgtgagcagccccaagaccgtgaccacccccacccccatcagccccggcgagatgagccccgagaccagcagccagcacagcgccatgagcagaatccccaccctgtacaccgccacccaggtgagcaccgagaacaccaacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagctgagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgagggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8683 - RNA, 5067 nt, synthetic construct
  misc_feature 1..5067: note = derived and/or modified CDS sequence (opt4) from CCHFV(4701-ST-2009)__KR814872.1__GP
  source 1..5067: mol_type = other RNA
atgcccatcaacatcatgcacaccctgctggtgtgcttcatcctgtacctgcagctgagcggcctgggcggcgcccacggccagagcaacgccaccgagcacaacggcaccaacaccaccaccgcccccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccctgaccggcaccacccccgagagaagcgccaccaccgccaccagcaccagcagcaccgacaacatgaacagcaccacccaggtgaccgacaacacccccaccagcaccgtgagcatcagccccagcagcagcagcagcatgcccagcaccccccagggcacccaccaccccgtgagaagcctgctgagcgtgagcagccccaagaccgtgaccacccccacccccatgagccccggcgagatgagccccgagaccagcagccagcacagcgccatgagcagagtgcccaccctgtacaccgccacccaggtgagcaccgagaacaccgacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacagaaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcggcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8684 - RNA, 5067 nt, synthetic construct
  misc_feature 1..5067: note = derived and/or modified CDS sequence (opt4) from CCHFV(4574-ST-2008)__KR814870.1__GP
  source 1..5067: mol_type = other RNA
atgcccaccaacatcatgcacaccctgctggtgtgcttcatcctgtacctgcagctgctgggccccggcggcgcccacggccagcccaacgccaccgagcacaacagaaccaacaccaccaccgcccccagcaccagccagagccccaagccccccgtgagcaccgcccccccccacgccctggagagccccaccatcaagagcaccacccccaccagcgagaccgagggcagcggcgagaccaccagcccccccaacaccacccagggccccagcctgcccgagaccacccccaagagacccgccaccaccgccaccagcacccccagcaccgacaacaccaacagcaccacccacgtgaccgacaacaaccccaccagcaccatcagcaccagccccagcagcagccccagcacccccagcacccccagaggcatccaccaccccgccagaaacctgctgagcgtgagcagccccaagaccgccaccacccccacccccaccagccccggcgagatcagcagcgagaccagcagcctgcacagcgccatgagcagaaccagcaccctgtacaccgccacccaggccagcaccgagaacgccaaccacagcgcccccagacagagcgagagccccgcccagcccaccaccaccagcctgatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgaggacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggtgagcaccggcagcagaaagctgctgagcgaggagagcggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcctgttctgcaaggccctgttctacagcctgatcatcatcggcaccctgggcaagaagatcaagcagtacagagagctgagaccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagagccagaggcctgctgaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggctga

SEQ ID NO: 8685 - RNA, 5067 nt, synthetic construct
  misc_feature 1..5067: note = derived and/or modified CDS sequence (opt4) from CCHFV(4495-ST-2008)__KR814869.1__GP
  source 1..5067: mol_type = other RNA
atgcccaccaacatcatgcacaccctgctggtgtgcttcatcctgtacctgcagctgctgggccccggcggcgcccacggccagcccaacgccaccgagcacaacagaaccaacaccaccaccgcccccagcaccagccagagccccaagccccccgtgagcaccgcccccccccacgccctggagagccccaccatcaagagcaccacccccaccagcgagaccgagggcagcggcgagaccacccccccccccaacaccacccagggccccagcccccccgagaccacccccgagagacccgccaccaccgccaccagcacccccagcaccgacaacaccaacagcaccacccacgtgaccgacaacaaccccaccagcaccatcagcaccagccccagcagcagccccagcacccccagcacccccagaggcatccaccaccccgccagaaacctgctgagcgtgagcagccccaagaccgccaccacccccacccccaccagccccggcgagatcagcagcgagaccagcagcctgcacagcgccatgagcagaaccagcaccctgtacaccgccacccaggccagcaccgagaacgccaaccacagcacccccagacagagcgagagccccgcccagcccaccaccaccagcctgatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggtgagcaccggcagcagaaagctgctgagcgaggagagcggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcctgttctgcaaggccctgttctacagcctgatcatcatcggcaccctgggcaagaagatcaagcagtacagagagctgagaccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagagatgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagagccagaggcctgctgaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggctga

SEQ ID NO: 8686 - RNA, 5067 nt, synthetic construct
  misc_feature 1..5067: note = derived and/or modified CDS sequence (opt4) from CCHFV(3809-ST-2007)__KR814867.1__GP
  source 1..5067: mol_type = other RNA
atgcccaccaacatcatgcacaccctgctggtgtgcttcatcctgtacctgcagctgctgggcctgggcggcgcccagggccagagcaacgccaccgagcacaacgagaccaacaccaccaccgcccccagcaccagccagagccccaagccccccgtgagcaccacccccctgcacgccctggagagcagcaccatcaagcccaccacccccgccagagagaccgagggcagcggcgagaccacccccccccccaacaccacccagggccccagcccccccgaggccacccccgagagacccgccaccaccgccaccagcgcccccagcaccgacaacaccaacagcaccacccacgtgaccgacaacaaccccaccagcaccatcagcaccagccccagcagcagccccagcacccccttcaccccccagggcatccaccaccccgccagaaacctgctgagcgtgagcagccccaagaccgccaccacccccacccccaccagccccggcgagctgagcagcgagaccagcagcctgcacagcgccatcagcagaaccagcaccctgtacaccgccacccaggtgagcaccgagaacgccaaccacagcgcccccagacagagcgagagcagcgcccagcccaccaccaccagccccatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccgccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcgtgaacggcttcgagatcgagagccacaagtgctactgcagcctgttctgctgcccctactgcagacactgcagcgccgacagagagatccaccagctgcacctgagcgtgtgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcagaagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctgacccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8687 - RNA, 5067 nt, synthetic construct
  misc_feature 1..5067: note = derived and/or modified CDS sequence (opt4) from CCHFV(3756-ST-2007)__KR814866.1__GP
  source 1..5067: mol_type = other RNA
atgcccatcaacatcatgcacaccctgctggtgtgcttcatcctgtacctgcagctgagcggcctgggcggcgcccacggccagagcaacgccaccgagcacaacagaaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccctgcccggcaccacccccgagagaagcgccaccaccgccaccagcaccagcagcaccgacaacatgaacaccaccacccaggtgaccgacaacacccccaccagcaccgtgagcatcagccccagcagcagccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccacccaggtgagcaccgagaacatcaacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacagaaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctgacccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8688 - RNA, 5067 nt, synthetic construct
  misc_feature 1..5067: note = derived and/or modified CDS sequence (opt4) from CCHFV(81-R-2014)__KR814865.1__GP
  source 1..5067: mol_type = other RNA
atgcccaccaacatcatgcacaccctgctggtgtgcttcatcctgtacctgcagctgctgggcctgggcggcgcccacggccagagcaacgccaccgagcacaacggcaccaacaccaccaccgtgcccagcaccagccagagccccaagcccctggtgagcaccacccccccccacgccctggagagcagcaccatcaagcccaccacccccaccagcgagaccgagggcagcggcgagaccgcccccctgcccaacaccacccagggcccccccccccccgagaccacccccgagagacccgccaccaccgtgaccagcacccccagcaccgacaacaccaacagcaccatccacgtgaccgacaacaaccccaccagcaccatcagcaccagccccagcagcagccccagcacccccagcaccccccagggcatccaccaccccgccagaagcctgctgagcgtgagcagccccaagaccgccaccacccccacccccaccagccccggcgagatcaacagcgagaccagcagcctgcacagcgccatgagcagaacccccaccctgcacaccgccacccaggtgagcaccgagaacgccaaccacagcgcccccagacagagcgagagcagcgcccagcccaccaccaccagcctgatgaccagccccgcccagagcatcctgctgatgagcgccgcccccaccgccatccagaacacccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcggcgagttcttcatgaccggcgagggctacttcaacgaggtgctgcagttcaagaccctgagcaccctgagccccaccgagcccagccacgccagactgcccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8689 - RNA, 5067 nt, synthetic construct
  misc_feature 1..5067: note = derived and/or modified CDS sequence (opt4) from CCHFV(75-ST-2010)__KR814864.1__GP
  source 1..5067: mol_type = other RNA
atgcccaccaacatcatgcacaccctgctggtgtgcttcatcctgtacctgcagctgctgggccccggcggcgcccacggccagcccaacgccaccgagcacaacagaaccaacaccaccaccgcccccagcaccagccagagccccaagccccccgtgagcaccgcccccccccacgccctggagagccccaccatcaagagcaccacccccaccagcgagaccgagggcagcggcgagaccacccccccccccaacaccacccagggccccagcctgcccgagaccacccccgagagacccgccaccaccgccaccagcacccccagcaccgacaacaccaacagcaccacccacgtgaccgacaacaaccccaccagcaccatcagcaccagccccagcagcagccccagcacccccagcacccccagaggcatccaccaccccgccagaaacctgctgagcgtgagcagccccaagaccgccaccacccccacccccaccagccccggcgagatcagcagcgagaccagcagcctgcacagcgccatgagcagaaccagcaccctgtacaccgccacccaggccagcaccgagaacgccaaccacagcgcccccagacagagcgagagccccgcccagcccaccaccaccagcctgatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggtgagcaccggcagcagaaagctgctgagcgaggagagcggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcctgttctgcaaggccctgttctacagcctgatcatcatcggcaccctgggcaagaagatcaagcagtacagagagctgagaccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagagccagaggcctgctgaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggctga

SEQ ID NO: 8690 - RNA, 5067 nt, synthetic construct
  misc_feature 1..5067: note = derived and/or modified CDS sequence (opt4) from CCHFV(75-R-2012)__KR814863.1__GP
  source 1..5067: mol_type = other RNA
atgcccaccaacatcatgcacaccctgctggtgtgcttcatcctgtacctgcagctgctgggcctgggcggcgcccacagacagagcaacgccaccggccacaacggcaccaacaccaccaccgcccccagcaccagccagagccccaagcccctggtgagcaccgcccccccccacgccctggagagcagcatcatcaagcacaccacccccgtgagcgagaccgagggcagcggcgagaccacccccccccccaacaccacccagggccccagccccctggagaccacccccgagagacccgccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagcctgaagaccgccaccacccccacccccaccagccccggcgagatcagcagcgagaccagcagcctgcacagcgccatgagcagaaccagcaccctgtacaccgccacccaggtgagcaccgagaacgccaaccacagcgcccccagacagagcgagagcagcgcccagcagaccaccaccagccccatgaccagccccgcccagagcatcctggtgatgagcgccgcccccaccgccatccagaacacccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcacccagagccccaccgagcccagccacgccagaccccccaccgtggagcccttcaagagctacttcgccaagggcttcctgagcatcgacagcggctacttcagcgccaagtgctaccccagactgagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcgcccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtgaacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcctgtacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8691 - RNA, 5067 nt, synthetic construct
  misc_feature 1..5067: note = derived and/or modified CDS sequence (opt4) from CCHFV(52-R-2014)__KR814862.1__GP
  source 1..5067: mol_type = other RNA
atgcccaccaacatcatgcacaccctgctggtgtgcttcatcctgtacctgcagctgctgggcctgggcggcgcccacagacagagcaacgccaccgagcacaacggcaccaacaccaccaccgcccccagcaccagccagagccccaagccccccgtgagcaccgcccccccccacgcccccgagagcagcaccatcaagcccaccacccccgccagcgagaccgagggcagcggcgagaccacccccccccccaacaccacccagggccccagcccccccgaggccacccccgagagacccgccaccaccgccaccagcacccccagcaccgacaacaccaacagcaccacccacgccaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgacatcagcagcgagaccagcagcctgcacagcgccatgagcagaacccccaccctgcacaccgccacccaggccagcaccgagaacgccaaccacagcgcccccagacagagcgagagcagcgcccagcagaccaccaccagccccatgaccagccccgcccagcccatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagactgagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacgtgcccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcgtgtgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggacgacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccggctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8692 - RNA, 5067 nt, synthetic construct
  misc_feature 1..5067: note = derived and/or modified CDS sequence (opt4) from CCHFV(47-ST-2013)__KR814861.1__GP
  source 1..5067: mol_type = other RNA
atgcccatcaacatcatgcacaccctgctggcctgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccccccccggcaccacccccgagagaagcgccaccaccgccaccagcaccagcagcaccgacaacatgaacagcaccacccagatgaccggcaacacccccacccccaccgtgaacatgagccccagcagcagccccagcatgcccagcaccagccagggcatccactaccccgtgagaagcctgctgagcgtgcccagccccaagaccgccaccacccccacccccgtgagccccggcgagatgagccccgagaccagcagccagcacagcgccaccagcagaatccccaccctgtacaccgccacccaggtgagcaccgagaacaccaacagaagcacccccagacagagcaagagcagcgtgcagcccgccacccagagccccatcaccccccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctactacgccaagggcttcctgagcctggacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactaccccctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcagaacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgttcatcagaagcatcatcaacaccaccttcgtgacctgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgagtgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8693 - RNA, 5067 nt, synthetic construct
  misc_feature 1..5067: note = derived and/or modified CDS sequence (opt4) from CCHFV(46-ST-2012)__KR814860.1__GP
  source 1..5067: mol_type = other RNA
atgcccaccaacatcatgcacaccctgctggtgtgcttcatcctgtacctgcagctgctgggcctgggcggcgcccacggccagagcaacgccaccgagcacaacggcaccaacaccaccaccgtgcccagcaccagccagagccccaagcccctggtgagcaccacccccccccacgccctggagagcagcaccatcaagcccaccacccccaccagcgagaccgagggcagcggcgagaccgcccccctgcccaacaccacccagggcccccccccccccgagaccacccccgagagacccgccaccaccgtgaccagcacccccagcaccgacaacaccagcagcaccatccacgtgaccgacaacaaccccaccagcaccatcagcaccagccccagcagcagccccagcacccccagcaccccccagggcatccaccaccccgccagaagcctgctgagcgtgagcagccccaagaccgccaccacccccacccccaccagccccggcgagatcaacagcgagaccagcagcctgcacagcgccatgagcagaacccccaccctgcacaccgccacccaggtgagcaccgagaacgccaaccacagcgcccccagacagagcgagagcagcgcccagcccaccaccaccagcctgatgaccagccccgcccagagcatcctgctgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagactgcccaccgtggagcccttcaagagctacttcgccaagggcttcctgagcgtggacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacgccaccttcgtgatctgcatcctgaccctgaccatctgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8694 - RNA, 5067 nt, synthetic construct
  misc_feature 1..5067: note = derived and/or modified CDS sequence (opt4) from CCHFV(44-ST-2010)__KR814859.1__GP
  source 1..5067: mol_type = other RNA
atgcccatcaacatcatgcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccccccccggcaccacccccgagagacccgccaccaccgccaccagcatgagcagcaccgacaacatgaacagcaccacccaggtgaccgacaacacccccaccagcaccgtgagcatcagccccagcagcagccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccacccaggtgagcaccgagaacaccaacagaagcacccccagacagagcgagagcagcgcccagcccgccacccagagccccaccaccagccccacccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgctgtggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcttcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgagcgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggaccagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgtgcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagagccacatcggctga

SEQ ID NO: 8695 - RNA, 5067 nt, synthetic construct
  misc_feature 1..5067: note = derived and/or modified CDS sequence (opt4) from CCHFV(37-R-2013)__KR814858.1__GP
  source 1..5067: mol_type = other RNA
atgcccaccaacatcatgcacaccctgctggtgtgcttcatcctgtacctgcagctgctgggcctgggcggcgcccacagacagagcaacgccaccgagcacaacggcaccaacaccaccaccgcccccagcaccagccagagccccaagccccccgtgagcaccgcccccccccacgcccccgagaccagcaccatcaagcccaccacccccgccagcgagaccgagggcagcggcgagaccacccccccccccaacaccacccagggccccagcccccccgaggccacccccgagagacccgccaccaccgtgaccagcacccccagcaccgacaacaccaacagcaccacccacgccaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgacatcagcagcgagaccagcagcctgcacagcgccatgagcagaacccccaccctgcacaccgccacccaggccagcaccgagaacgccaaccacagcgcccccagacagagcgagagcagcgcccagcagaccaccaccagccccatgaccagccccgcccagcccatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagactgaccaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcgtgtgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggacgacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgtgacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8696 - RNA, 5067 nt, synthetic construct
  misc_feature 1..5067: note = derived and/or modified CDS sequence (opt4) from CCHFV(36-ST-2014)__KR814857.1__GP
  source 1..5067: mol_type = other RNA
atgcccatcaacatcatgcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccccccccggcaccacccccgagagacccgccaccaccgccaccagcatgagcagcaccgacaacatgaacagcaccacccaggtgaccgacaacacccccaccagcaccgtgagcatcagccccagcagcagccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccacccaggtgagcaccgagaacaccaacagaagcacccccagacagagcgagagcagcgcccagcccgccacccagagccccaccaccagccccacccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgagcgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggaccagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgtgcggctggaagttcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagagccacatcggctga

SEQ ID NO: 8697 - RNA, 5067 nt, synthetic construct
  misc_feature 1..5067: note = derived and/or modified CDS sequence (opt4) from CCHFV(24-R-2012)__KR814856.1__GP
  source 1..5067: mol_type = other RNA
atgcccaccaacatcatgcacaccctgctggtgtgcttcatcctgtacctgcagctgctgggcctgggcggcgcccacagacagagcaacgccaccgagcacaacggcaccaacaccaccaccgcccccagcaccagccagagccccaagccccccgtgagcaccgcccccccccacgcccccgagagcagcaccatcaagcccaccacccccgccagcgagaccgagggcagcggcgagaccacccccccccccaacaccacccagggccccagcccccccgaggccacccccgagagaaccgccaccaccgccaccagcacccccagcaccgacaacaccaacagcaccacccacgccaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgacatcagcagcgagaccagcagcctgcacagcgccatgagcagaacccccaccctgcacaccgccacccaggccagcaccgagaacgccaaccacagcgcccccagacagagcgagagcagcgcccagcagaccaccaccagccccatgaccagccccgcccagcccatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagactgagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcgtgtgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8698 - RNA, 5064 nt, synthetic construct
  misc_feature 1..5064: note = derived and/or modified CDS sequence (opt4) from CCHFV(Oman-199809166)__KR864901.1__GP
  source 1..5064: mol_type = other RNA
atgcccgtgaacaccatgcacaccctgctggtgtacgccgtgttctgcctgcagctgtggagccccggcggcaccagaggcctgagcaacgagacccagcacaacgagaccggcatcaccagagcccccgagggcagccagggccccagcctgcccgtgagcaccgccagccccatcatgagcgaccccagcatcaccaccctgagcgccagcaccagcggcctggagggcagcggcgacaccaccccccccgccatcacccagggccccaccctgcccgagaccacccccgagcccagcaccaccaccggcaccaacgccttcagcaccgccatcgccaacgtgagcacccagaccgtgaaggacacccccacccccaccgtgcagaccagcccccccagcacccccgacgccagcaccatcccccagggcacccaccacaccgccagaggcctgctgagcgtgaccgtgaccaagcccgaggaggtgcccacccccaccggccccgagcaggccagcatcgagaccaacagcagcagactggccaccagcaagacccccagccccagccccaccgcccaggtgaccaccgagaacagcaaccccaacaccagcagacagctggtgctgagcacccagcccgccaccagcagccccgtgaccagccccgcccagctgaacttcgtgcagagcgccaccaccatcgccgtgcaggacgcccaccccagccccaccaacagaagcaagagaaacctggagatggaggtgatcctgaccctgagccagggcctgagaaagtactacggcagaatcctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagccccaccgagagcgccagcgtgggcctgcccaccgtggagcccttcaagagctacttcgccaagggcttcctgagcatcgacagcggctacttcagcgccaagtgctaccccagagccagcaacagcggcctgcagctgatcaacgtgacccagcacagcgccagaatcgccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgcacatcaagagccacgtgtgcgactacagcctggacatcgacggcaccgtgagactgcccagaatccaccacgagggcaccttcatccccggcacctacaagatcgtgatcgacaagaagaacaagcagaacgacagatgcaacctggtgaccaactgcgtgatcaagggcagagaggtgagaaagggccagagcgtgctgagacagtacagaaccgagatcagaatcggcaaggccagcagcggcagcagaagactgctgagcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacaccagcatctgcctgttcgtgctgggcagcatcctgttcatcgtgagccacctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacaaggagatccacaagctgcacctgagcatctgcaagaagagaaaggccggcagcaacgtgatgctggccgtgtgcaagagaatgtgcttcagagccaccatggaggtgagcaacaaggccctgctgatcagaagcgtgatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8699 - RNA, 5064 nt, synthetic construct
  misc_feature 1..5064: note = derived and/or modified CDS sequence (opt4) from CCHFV(Oman_812956)__KY362518.1__GP
  source 1..5064: mol_type = other RNA
atgcccgtgaacaccatgcacaccctgctggtgtacgccgtgttctgcctgcagctgtggagccccggcggcaccagaggcctgagcaacgagacccagcacaacgagaccggcatcaccagagcccccgagggcagccagggccccagcctgcccgtgagcaccgccagccccatcatgagcgaccccagcatcaccaccctgagcgccagcaccagcggcctggagggcagcggcgacaccaccccccccgccatcacccagggccccaccctgcccgagaccacccccgagcccagcaccaccaccggcaccaacgccttcagcaccgccatcgccaacgtgagcacccagaccgtgaaggacacccccacccccaccgtgcagaccagcccccccagcacccccgacgccagcaccatcccccagggcacccaccacaccgccagaggcctgctgagcgtgaccgtgaccaagcccgaggaggtgcccacccccaccggccccgagcaggccagcatcgagaccaacagccccagactggccaccagcaagacccccagccccagccccaccgcccaggtgaccaccgagaacagcaaccccaacaccagcagacagctggtgctgagcacccagcccgccaccagcagccccgtgaccagccccgcccagctgaacttcgtgcagagcgccaccaccatcgccgtgcaggacgcccaccccagccccaccaacagaagcaagagaaacctggagatggaggtgatcctgaccctgagccagggcctgagaaagtactacggcagaatcctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagccccaccgagagcgccagcgtgggcctgcccaccgtggagcccttcaagagctacttcgccaagggcttcctgagcatcgacagcggctacttcagcgccaagtgctaccccagagccagcaacagcggcctgcagctgatcaacgtgacccagcacagcgccagaatcgccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgcacatcaagagccacgtgtgcgactacagcctggacatcgacggcaccgtgagactgcccagaatccaccacgagggcaccttcatccccggcacctacaagatcgtgatcgacaagaagaacaagcagaacgacagatgcaacctggtgaccaactgcgtgatcaagggcagagaggtgagaaagggccagagcgtgctgagacagtacagaaccgagatcagaatcggcaaggccagcagcggcagcagaagactgctgagcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacaccagcatctgcctgttcgtgctgggcagcatcctgttcatcgtgagccacctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacaaggagatccacaagctgcacctgagcatctgcaagaagagaaaggccggcagcaacgtgatgctggccgtgtgcaagagaatgtgcttcagagccaccatggaggtgagcaacaaggccctgctgatcagaagcgtgatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcttcgacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8700 - RNA, 5064 nt, synthetic construct
  misc_feature 1..5064: note = derived and/or modified CDS sequence (opt4) from CCHFV(Oman)__DQ211632.1__GP
  source 1..5064: mol_type = other RNA
atgcccgtgaacaccatgcacaccctgctggtgtacgccgtgttctgcctgcagctgtggagccccggcggcaccagaggcctgagcaacgagacccagcacaacgagaccggcatcaccagagcccccgagggcagccagggccccagcctgcccgtgagcaccgccagccccatcatgagcgaccccagcatcaccacccccagcgccagcaccagcggcctggagggcagcggcgacaccaccccccccgccatcacccagggccccaccccccccgagaccacccccgagcccagcaccaccaccggcaccaacgccttcagcaccgccatcgccaacgtgagcacccagaccgtgaaggacacccccacccccaccgtgcagaccagcccccccagcacccccgacgccagcaccatcccccagggcacccaccacaccgccagaggcctgctgagcgtgaccgtgaccaagcccgaggaggtgcccacccccaccggccccgagcaggccagcatcgagaccaacagccccagactggccaccagcaagacccccagccccagccccaccgcccaggtgaccaccgagaacagcaaccccaacaccagcagacagctggtgctgagcacccagcccgccaccagcagccccgtgaccagccccgcccagctgatcttcgtgcagagcgccaccaccgtggccgtgcaggacgcccaccccagccccaccaacagaagcaagagaaacctggagatggaggtgatcctgaccctgagccagggcctgagaaagtactacggcagaatcctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagcagcaccgagagcgccagcgtgggcctgcccaccgtggagcccttcaagagctacttcgccaagggcttcctgagcatcgacagcggctacttcagcgccaagtgctaccccagagccagcaacagcggcctgcagctgatcaacgtgacccagcacagcgccagaatcgccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgcacatcaagagccacgtgtgcgactacagcctggacatcgacggcaccgtgagactgcccagaatccaccacgagggcaccttcatccccggcacctacaagatcgtgatcgacaagaagaacaagcagaacgacagatgcaacctggtgaccaactgcgtgatcaagggcagagaggtgagaaagggccagagcgtgctgagacagtacagaaccgagatcagaatcggcaaggccagcagcggcagcagaagactgctgagcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacaccagcatctgcctgttcgtgctgggcagcatcctgttcatcgtgagccacctgatgaagggcctggtggacagcgtgggcaacagcttcttccccggcctgagcatctgcaagacctgcagcatcggcagcatcaacggcttcgagatcgagagccacaagtgcttctgcagcctgttctgctgcccctactgcagacactgcagcgccgacaaggagatccacaagctgcacctgagcatctgcaagaagagaaaggccggcagcaacgtgatgctggccgtgtgcaagagaatgtgcttcagagccaccatggaggtgagcaacaaggccctgctgatcagaagcgtgatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8701 - RNA, 5064 nt, synthetic construct
  misc_feature 1..5064: note = derived and/or modified CDS sequence (opt4) from CCHFV(3820-ST-2007)__KR814868.1__GP
  source 1..5064: mol_type = other RNA
atgcccatcaacatcatgcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccaccccccccaacaccacccagggcctgcccctgcccggcaccacccccgagagaagcgccaccaccgccaccagcaccagcagcaccgacaacatgaacagcaccacccaggtgaccgacaacacccccaccagcaccgtgagcatcagccccagcagcagcagcagcatgcccagcaccagccagggcatccaccaccccgtgagaagcctgctgagcgtgagcagccccaagaccgtgaccacccccacccccatgagccccggcgagatgagccccgagaccagcagccagcacagcgccatgagcagagtgcccaccctgtacaccgccacccagatcagcaccgagaacaccgacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacagaaagaacaagctgaacgacagatgcagcctggtgaccaactgcgtgatcaagggcagagaggtgagaaagggccagagcgtgctgagacagtacaagaccgagatcaagatcggcaagaccagcaccggcagcagaaagctgctgagcgaggagcccggcgacgactgcatcagcagaacccagctgctgaagaccgagaccgccgagatccacgacgacaactacggcagccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctggccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8702 - RNA, 5058 nt, synthetic construct
  misc_feature 1..5058: note = derived and/or modified CDS sequence (opt4) from CCHFV(SR3)__AJ538199.1__GP
  source 1..5058: mol_type = other RNA
atgcacatcagcctgatgtacgccgtgttctgcctgcagctgtgcggcctgggcaagaccaacggcccccacaacggcaccgagcacaacaacacccacgtgatgaccacccccgacgacagccagagccccgagccccccgtgagcaccgccctgcccgtgacccccgaccccagcaccgtgacccccagcacccccgccagcggcctggagggcagcggcgaggtgtacaccagcagccccatcaccaccaagggcctgagcctgcccgaggccaccagcgagccccccgccaccaccagcgtggtgaccagcagcgccagcgacaccgacagcagcacccaggccgccggcgacacccccacccccaccgtgagaaccagcctgcccagcagccccagcacccccagcaccagccagggcacccactaccccgtgagaagcctgctgagcgtgaccagccccaagcccgaggagacccccacccccagcaagagcggcaaggacgacctggccaccaacagcccccaccccgccaccagcagacccaccaccccccccaccaccgcccagaagcccaccgagaacaacagccacaacaccaccgagcagctggagagcctgacccacctggccaccctgggcctgatgatcagccccacccagaccgtgctgccccagagcgtgaccagcatcgccatccaggacatccacaacagccccaccaacagaagcaagagaaacctggacatggagatcatcctgaccctgagccagggcctgaagaagtactacggcaagatcctgaagctgctgcacctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaaccctgggcaccctgagcaccaccgagagcacccacgccggcagccccaccgtggagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcaactgcatgaacctgaaggccagcgtgttcaaggagcacagagaggtggagatcaacgtgctgctgccccaggtggccgtgaacctgagcaactgccacgtggccatcaagagccacatctgcgactacagcctggacaccgacggcgccatcagactgccccagatccaccacgagggcaccttcatccccggcacctacaagatcgtgatcgacaagaagagcagactgaacgacagatgcaccctgttcaccaactgcgtgatcaagggcagagaggtgagaaagggccagagcgtgctgagacagtacaagaccgagatcagaatcggcagagccagcaccggcagcagaagactgctgagcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggccacggcaagaccatcgagacctacagagtgagagaggagtacaccagcatctgcctgttcgtgctgggcagcatcctgttcatcgtgagcttcctgatgaagggcctggtggacggcgtgggcaacatcttcttccccggcctgagcgtgtgcaagacctgcagcatcggcagcatcaacggcttcgagatcgagagccacaagtgctactgcagcctgttctgctgcccctactgcagacactgcagcgccgacggcgagatccaccagctgcacctgagcatctgcaagaagagaaagaccggcagcaacgtgatgctggccgtgtgcaagagaatgtgcttcagagccaccatggaggtgagcaacaaggccctgttcatcagaagcatcatcaacaccaccttcgtgatgtgcatcctgaagggcgagttcgccgccgtgaagagcatccaccccatcgagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcaacaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggctga

SEQ ID NO: 8703 - RNA, 5055 nt, synthetic construct
  misc_feature 1..5055: note = derived and/or modified CDS sequence (opt4) from CCHFV(SPU 187/90)__KJ682814.1__GP
  source 1..5055: mol_type = other RNA
atgcacatcagcctgatgtacgccgtgctgtgcctgcagctgtgcagcctgggcgagacccacagaagccacaacgagatcggccacaacaagaccgacgtgatgaccacccccggcgacaacctgagcagcgagcagcccgtgagcaccgccctgagcatcacccccgaccccagcaccgtgacccccaccacccccgccagcggcagcgagggcagcggcgaggtgtacaccagcagccccatcaccaccgagagcctgagcctgcccgagaccacccccgagctgcccgccaccaccggcatcgacagcagcagcgccagcggcgtggacagcagcacccaggccgccggcggcaccagcgccctgaccgtgagaaccagcctgcccaacagccccagcacccccagcaccccccaggacacctaccaccccgtgagaatcctgctgagcgtgaccggccccggccccgaggagaccagcacccccagcggcagcggcaaggagagcagcgccaccagcagcctgcaccccatcagcgacagactgcccaccccccccgccaccgcccagggccccaccgagaacaacagccacaacgccaccgagcaccccaagcccctgacccagagcgccacccccggcctgatgaccagccccacccagatcgtgcacccccagagcgccaccagcatcaccgtgcaggacacctaccccagccccaagaacagaagcaagagaaacctggagatggagatcatcctgaccctgagccagggcctgaagaagtactacggcaagatcctgagactgctgagactgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcaagacccccggcaccctgagcaccaccgagagcacccccgccgagctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccagatcgccgtgaacctgagcaactgccacgtggtgatcaagagccacgtgtgcgactacagcctggacatcgacggcaccgtgagactgccccacatctaccacgagggcgtgttcatccccggcacctacaagatcgtgatcgacaagaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccacggcaagaccatcgaggcctacagagccagagagggctacaccagcatctgcctgttcgtgctgggcagcatcctgttcgtggtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacaaggagatccacaagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcatcttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaagaccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8704 - RNA, 5055 nt, synthetic construct
  misc_feature 1..5055: note = derived and/or modified CDS sequence (opt4) from CCHFV(SPU 48/90)__KJ682813.1__GP
  source 1..5055: mol_type = other RNA
atgcacatcagcctgatgtacgccgtgctgtgcctgcagctgtgcggcctgggcgagacccacagaagccacaacgagaccggccacaacaagaccgacgtggccaccacccccggcgacaacctgagcagcgagcagctggtgagcaccgccctgagcatcacccccgaccccagcaccgtgacccccaccaccagcgccagcggcctggagggcagcggcgaggtgtacaccagcagcctgatcaccaccgagagcctgagcctgctggagaccacccccaagctgcccaccaccaccggcatcgacaccagcagcgccagcgacgtggacagcagcacccaggccgccggcgacaccagcgccctgaccgtgagaaccagcccccccagcaaccccagcacccccagcaccccccaggacacccaccaccccatgagaaacctgctgagcgtgaccagccccggccccgaggagaccagcacccccagcggcagcggcaaggagagccccgccaccagcagcccccaccccgtgagcaacagaagccagaccccccccgccaccgcccagggccccaccgaggacaacagctacaacgccaccgagcaccccgagcacctgacccagagcgccaccagcggcctgatgaccagccccacccagatcgtgcacccccagagcgccaccagcatcaccgtgcaggacacctaccccagccccaccaacagaagcaagagaaacctggagatggagatcatcctgaccctgagccagggcctgaagaagtactacggcaagatcctgagactgctgagactgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcaagacccccggcaccctgagcaccaccgagagcacccccgccgagccccccaccgccgagcccttcaagagctacttcgccaagggcttcctgagcatcgacagcggctactacagcgccaagtgctacagcggcaccagcaacagcggcctgcagctgatcaacatcaccagacacagcaccaagatcgccgacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactaccccctggacatcgacggcaccgtgagactgccccacatctaccacgagggcgtgttcatccccggcacctacaagatcgtgatcgacaagaagaccaagctgaacgacagatgcaccctgttcaccgactgcgtgatcaagggcagagaggtgagaaagggccagagcgtgctgagacagtacaagaccgagatcagaatcggcaagaccagcaccggcagcagaagactgctgagcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgtgatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaccaccaccatggccttcctgttctggttcagcttcggctacgtgatcacctgcatcctgtgcaaggccatcttctacctgctgatcatcatcggcaccctgggcaagagattcagacagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccacggcaagaccatcgaggcctacagagccagagagggctacaccagcatctgcctgttcgtgctgggcagcatcctgttcgtggtgagctgcctgatgaagagactggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcgccgacaaggagatccacaagctgcacctgagcatctgcaagaagagaaagaccggcagcaacgtgatgctggccgtgtgcaagagaatgtgcttcagagccaccatggaggtgagcgacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcagagacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaacagagccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagaaggagtactgcaagagctgcagcgaggaggacaccaagaagtgcgtgaacaccaagctggagcagccccagagcatcctgatcgagcacaagggcaccatcatcggcaagcagaacagcacctgcaccgccaaggtgagctgctggctggagagcgccaagagcttcttctacggcctgaaggacatgctgagcggcatcttcggcaacgtgttcatcggcatcttcctgttcctggcccccttcatcctgctgatcctgttcttcatgttcggctggagaatcctgctgtgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8705 - RNA, 5055 nt, synthetic construct
  misc_feature 1..5055: note = derived and/or modified CDS sequence (opt4) from CCHFV(Sudan AB1-2009)__HQ378187.1__GP
  source 1..5055: mol_type = other RNA
atgcacatcagcctgatctacgccatcctgtgcctgcagctgtgcggcctgggcgagacccacggcagccacaacgagaccagacacaacaagaccgacaccatcaccacccccggcgacaacctgagcagcgagcccagcgtgagcaccgccctgagcatcacccccgaccccagcaccgtgacccccaccacccccgccagcggcctggagggcagcggcgaggtgtacaccagcccccccatcaccaccggcagcctgcccctgcccggcaccacccccgagctgcccgccaccaccggcaccgacaccagcagcgccagcgacgtggacagcagcacccagaccgccggcggcaccttcaccctgaccgtgagaaccagcctgcccagaagccccagcacccccagcaccccccaggacacccaccaccccgtgagaaacctgctgagcgtgaccagccccggccccgacgagaccagcacccccagcggcaccggcaaggagagccccgccaccagcagcccccaccccgtgagcaacagaccccccaccccccccgccaccgcccagggccccaccgagaacgacagccacaacgccaccgagcaccccgagagcctgacccagagcgccaccaccggccccatgaccagccccacccagatcgtgcacccccagagcgccacccccatcaccgtgcaggacacccaccccagccccaccaacagaagcaagagaaacctggagatggagatcatcctgaccctgagccagggcctgaagaagtactacggcaagatcctgagactgctgcacctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccccgccggcctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactacagcctggacatcgacggcgccgtgagactgccccacatctaccacgagggcgtgttcatccccggcacctacaagatcgtgatcgacaagaagaacaagctgaacgacagatgcaccctgttcaccaactgcgtgatcaagggcagagaggtgagaaagggccagagcgtgctgagacagtacaagaccgaggtgagaatcggcaaggccagcaccggcagcagaagactgctgagcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacctgatcacctgcatcctgtgcaaggccatcttctacctgctgatcatcatcggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcaacgaggaggacaccaagaagtgcgtgaacaccaagctggagcagccccagagcatcctgatcgagcacaagggcaccatcatcggcaagcagaacagcacctgcaccgccagagccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8706 - RNA, 5055 nt, synthetic construct
  misc_feature 1..5055: note = derived and/or modified CDS sequence (opt4) from CCHFV(Sudan Al-Fulah 9-2008)__HQ378185.1__GP
  source 1..5055: mol_type = other RNA
atgcacatcagcctgatgtacgccgtgctgtgcctgcagctgtgcggcctgggcgagacccacagaagccacaacgagaccgtgcacaacaagaccgacatcgtgaccacccccagcgacgacctgagcagcgagcagctggtgagcaccgccctgagcatcacccccgaccccagcaccgtgacccccaccaccagcgccagcggcctggagggcagcggcgaggtgtacaccagcagccccatcaccaccgagagcctgagccagcccgagaccacccccaagctgcccgccaccaccggcatcgacaccagcagcgccagcgacgtggacagcagcacccaggccgccggcgacaccagcaccctgaccgtgagaaccagcccccccaacagccccagcacccccagcaccccccaggacacccaccaccccatgagaaacctgctgagcgtgaccagccccggccccgaggagaccagcacccccagcggcagcggcaaggagagcagcgccaccagcagcccccaccccgtgagcaacagaccccagaccccccccgccaccgcccagggccccaccgaggacaacagccacaacgccaccgagcaccccgagcacctgacccagagcgccaccagcggccccatgaccagccccacccagatcgtgcacccccagagcgccaccaccatcaccgtgcaggacacctaccccagccccaccaacagaagcaagagaaacctggagatggagatcatcctgaccctgagccagggcctgaagaagtactacggcaagatcctgagactgctgagactgaccctggaggaggacaccgagggcctgctggagtggtgcaagagaaacctgggcctggactgcgacgacaccttcttccagaagagaatcgaggagttcttcatcaccggcgagggccacttcaacgacgtgctgcagttcaagacccccggcaccctgagcaccaccgagagcacccccgccaagccccccaccgccgagcccttcaagagctacttcgccaagggcttcctgaccatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactaccccctggacatcgacggcaccgtgagactgccccacatctaccacgagggcgtgttcatccccggcacctacaagatcgtgatcgacaagaagaacaagctgaacgacagatgcaccctgttcaccgactgcgtgatcaagggcagagaggtgagaaagggccagagcgtgctgagacagtacaagaccgagatcagaatcggcaaggccagcaccggcagcagaagactgctgagcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgtgatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcagacagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccacggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcgccgacaaggagatccacaagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagaaggagtactgcaagagctgcagcgaggaggacaccaagaagtgcgtgaacaccaagctggagcagccccagagcatcctgatcgagcacaagggcaccatcatcggcaagcagaacagcacctgcaccgccaaggtgagctgctggctggagagcgccaagagcttcttctacggcctgaaggacatgctgagcggcatcttcggcaacgtgttcatcggcatcttcctgttcctggcccccttcgtgctgctggtgctgttcttcatgttcggctggagaatcctgctgtgcttcagatgctgcagaagaaccagaggcctgttcaagtacagacacctgaaggacgacgaggagaccggctacagaagaatcatcgagagactgaacaacaagaagggcaagaacaagctgctggacggcgagagactggccgacagaaagatcgccgagctgttcagcaccaagacccacatcggctga

SEQ ID NO: 8707 - RNA, 5055 nt, synthetic construct
  misc_feature 1..5055: note = derived and/or modified CDS sequence (opt4) from CCHFV(SPU4/81)__DQ157175.1__GP
  source 1..5055: mol_type = other RNA
atgcacatcagcctgatgtacgccgtgctgtgcctgcagctgtgcggcctgggcgagacccacggcagctacaacgagaccggccacaacaagaccgacgtgatgaccacccccggcgacaacctgagcagcgagcagcccgtgagcaccgccctgagcatcacccccgaccccagcaccgtgacccccaccacccccgccaacggcctggagggcagcggcgaggtgtacaccagcagccccatcaccaccgagagcctgagcctgcccgagaccacccccgagctgcccgccaccgccggcatcgacaccagcagcgccagcgacgtggacagcagcacccaggccgccggcggcaccagcgcccccaccgtgagaaccagcctgcccaacagccccagcacccccagcaccccccaggagacccaccaccccgtgagaaacctgctgagcgtgaccagcctgggccccgaggagaccagcacccccagcggccccggcaaggagagcagcgccaccagcagcccccaccccgtgagcaacaagccccccaccccccccgccagagcccagggccccaccgagaacaacagccacaacgccaccgagcaccccgagcccctgacccagagcgccacccccggcctgatgaccagccccacccaggtggtgcacccccagagcgccaccagcatcaccgtgcaggacacctaccccagccccaccaacagaagcaagagaaacctggagaccgagatcatcctgaccctgagccagggcctgaagaagtactacggcaagatcctgagactgctgagactgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcaagacccccggcaccctgagcaccaccgagagcacccccgccgagctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggccgccgtgaacctgagcaactgccacgtggtgatcaagagccacgtgtgcgactacagcctggacatcgacggcaccgtgagactgccccacatctaccacgagggcgtgttcatccccggcacctacaagatcgtgatcgacaagaaggacaagctgaacgacagatgcaccctgttcaccgactgcgtgatcaagggcagagaggtgagaaagggccagagcgtgctgagacagtacaagaccgagatcagaatcggcaaggccagcatcggcagcagaagactgctgagcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgagagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccacggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcgccgacaaggagatccacaagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatcggcatcttcctgttcctgggccccttcatcctgctgatcctgttcttcatgttcggctggagaatcctgttctgcttcaagtgctgcagaagaaccagaggcctgctgaagtacagacacctgaaggaggacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8708 - RNA, 5055 nt, synthetic construct
  misc_feature 1..5055: note = derived and/or modified CDS sequence (opt4) from CCHFV(NIV 11703)__JN572086.1__GP
  source 1..5055: mol_type = other RNA
atgcacaccagcctgatctacgtggtgctgtgcctgcagctgtgcagcctgggcaagacccacggcagccacaacggcaccgagcacaacaagaccgacgtgatgaccacccccggcgacaaccagagccccgagcccctggtgagcaccgccctgcccgtgacccccgaccccagcaccgtgacccccaccgcccccgccagcggcctggagggcagcggcgaggtgtacaccagcagcagcatcaccaccaagggcctgagcctgcccaaggccaccagcgagctgctggccaccaccggcatggtgaccagcagcgccagcgacatcgaccccagcacccaggccgccggcgacacccccacccccaccgtgagaaccagcctgcccaacagccccagcacccccagcaccagccaggacacccaccaccccgtgagaaacctgctgagcgtgaccagccccaagcccgaggagacccccacccccagcaagagcgacaaggacagcagcgccaccaacagcccccaccccgccgccagcagactgagcaccccccccaccaccgaccagggccccaccgagaacaacaaccacaacagcaccgagcagctggagagcctgaccagaagcgccaccagcagcagcatggtgagcctgacccagaccgtgctgccccagagcgccaccagcatcgccacccaggacacccaccccagccccaccaacagaagcaagagaaacctggagatggagatcatcctgaccctgccccagggcctgaagaagtactacggcaagatcctgaagctgctgcacctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagagcccccggcaccctgagcaccaccgagcccacccacgccggcagccccaccgccgagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcaactgcatcaacctgaaggccagcgtgttcaaggagcacagagaggtggagatcaacgtgctgctgccccaggtggccgtgaacctgagcaactgccacgtggccatcaagagccacgtgtgcgactacagcctggacaccgacggcgccatcagactgccccacatccactacgagggcaccttcatccccggcacctacaagatcgtgatcgacaagaagaacaagctgaacgacagatgcaccctgttcaccaactgcgtgatcaagggcagagaggtgagaaagggccagagcgtgctgagacagtacaagaccgagatcagaatcggcagagccagcaccggcagcagaagactgctgagcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcatcgccctgaagagaagcagctggctgatcgtgctgctggtgctgttcaccgtgagcatcacccccgtgcagagcgcccccatcggccacggcaagaccatcgaggcctacagagccagagaggagtacaccagcatctgcctgttcgtgctgggcagcgtgctgttcgtggtgagctgcctgatgaagggcctggtggacagcgtgggcaacatcttcttccccggcctgttcatctgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagaaccaccatggaggtgagcaacaaggccctgttcgtgagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagagcggcaccgacagcaccttcaaggccttcagcgccatgcccaagaccagcctgtgcttctacatcgtggagagagagtactgcaagggctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcctgggcatcttcagcttcctggcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8709 - RNA, 5055 nt, synthetic construct
  misc_feature 1..5055: note = derived and/or modified CDS sequence (opt4) from CCHFV(NIV 112143)__JN572085.1__GP
  source 1..5055: mol_type = other RNA
atgcacaccagcctgatctacgtggtgctgtgcctgcagctgtgcagcctgggcaagacccacggcagccacaacggcaccgagcacaacaagaccgacgtgatgaccacccccggcgacaaccagagccccgagcccctggtgagcaccgccctgcccgtgacccccgaccccagcaccatcacccccaccgcccccgccagcggcctggagggcagcggcgaggtgtacaccagcagcagcatcaccaccaagggcctgagcctgcccaaggccaccagcgagctgctggccaccaccggcatggtgaccagcagcgccagcgacatcgaccccagcacccaggccgccggcgacacccccacccccaccgtgagaaccagcctgcccaacagccccagcacccccagcaccagccaggacacccaccaccccgtgagaaacctgctgagcgtgaccagccccaagcccgaggagacccccacccccagcaagagcgacaaggacagcagcgccaccaacagcccccaccccgccgccagcagactgagcaccccccccaccaccgaccagggccccaccgagaacaacaaccacaacagcaccgagcagctggagagcctgaccagaagcgccaccagcagcagcatggtgagcctgacccagaccgtgctgccccagagcgccaccagcatcgccacccaggacacccaccccagccccaccaacagaagcaagagaaacctggagatggagatcatcctgaccctgccccagggcctgaagaagtactacggcaagatcctgaagctgctgcacctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagagcccccggcaccctgagcaccaccgagcccacccacgccggcagccccaccgccgagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcaactgcatcaacctgaaggccagcgtgttcaaggagcacagagaggtggagatcaacgtgctgctgccccaggtggccgtgaacctgagcaactgccacgtggccatcaagagccacgtgtgcgactacagcctggacaccgacggcgccatcagactgccccacatccactacgagggcaccttcatccccggcacctacaagatcgtgatcgacaagaagaacaagctgaacgacagatgcaccctgttcaccaactgcgtgatcaagggcagagaggtgagaaagggccagagcgtgctgagacagtacaagaccgagatcagaatcggcagagccagcaccggcagcagaagactgctgagcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcatcgccctgaagagaagcagctggctgatcgtgctgctggtgctgttcaccgtgagcatcacccccgtgcagagcgcccccatcggccacggcaagaccatcgaggcctacagagccagagaggagtacaccagcatctgcctgttcgtgctgggcagcgtgctgttcgtggtgagctgcctgatgaagggcctggtggacagcgtgggcaacatcttcttccccggcctgttcatctgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgttcgtgagaagcatcatcaacaccaccttcgtggtgtgcatcctgatcctggccatctgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagggctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcctgggcatcttcagcttcctggcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8710 - RNA, 5055 nt, synthetic construct
  misc_feature 1..5055: note = derived and/or modified CDS sequence (opt4) from CCHFV(NIVA 118594)__JN572084.1__GP
  source 1..5055: mol_type = other RNA
atgcacaccagcctgatctacgtggtgctgtgcctgcagctgtgcagcctgggcaagacccacggcagccacaacggcaccgagcacaacaagaccgacgtgatgaccacccccggcgacaaccagagccccgagcccctggtgagcaccgccctgcccgtgacccccgaccccagcaccgtgacccccaccgcccccgccagcggcctggagggcagcggcgaggtgtacaccagcagcagcatcaccaccaagggcctgagcctgcccaaggccaccagcgagctgctggccaccaccggcatggtgaccagcagcgccagcgacatcgaccccagcacccaggccgccggcgacacccccacccccaccgtgagaaccagcctgcccaacagccccagcacccccagcaccagccaggacacccaccaccccgtgagaaacctgctgagcgtgaccagccccaagcccgaggagacccccacccccagcaagagcgacaaggacagcagcgccaccaacagcccccaccccgccgccagcagactgagcaccccccccaccaccgaccagggccccaccgagaacaacaaccacaacagcaccgagcagctggagagcctgaccagaagcgccaccagcagcagcatggtgagcctgacccagaccgtgctgccccagagcgccaccagcatcgccacccaggacacccaccccagccccaccaacagaagcaagagaaacctggagatggagatcatcctgaccctgccccagggcctgaagaagtactacggcaagatcctgaagctgctgcacctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagagcccccggcaccctgagcaccaccgagcccacccacgccggcagccccaccgccgagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcaactgcatcaacctgaaggccagcgtgttcaaggagcacagagagttcgagatcaacgtgctgctgccccaggtggccgtgaacctgagcaactgccacgtggccatcaagagccacgtgtgcgactacagcctggacaccgacggcgccatcagactgccccacatccactacgagggcaccttcatccccggcacctacaagatcgtgatcgacaagaagaacaagctgaacgacagatgcaccctgttcaccaactgcgtgatcaagggcagagaggtgagaaagggccagagcgtgctgagacagtacaagaccgagatcagaatcggcagagccagcaccggcagcagaagactgctgagcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcatcgccctgaagagaagcagctggctgatcgtgctgctggtgctgttcaccgtgagcatcacccccgtgcagagcgcccccatcggccacggcaagaccatcgaggcctacagagccagagaggagtacaccagcatctgcctgttcgtgctgggcagcgtgctgttcgtggtgagctgcctgatgaagggcctggtggacagcgtgggcaacatcttcttccccggcctgttcatctgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagaaccaccatggaggtgagcaacaaggccctgttcgtgagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagagcggcaccgacagcaccttcaaggccttcagcgccatgcccaagaccagcctgtgcttctacatcgtggagagagagtactgcaagggctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcctgggcatcttcagcttcctggcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8711 - RNA, 5055 nt, synthetic construct
  misc_feature 1..5055: note = derived and/or modified CDS sequence (opt4) from CCHFV(UCCR4448)__KY484042.1__GP
  source 1..5055: mol_type = other RNA
atgcacatcagcctgatgtacgccgtgctgtgcctgcagctgtgcggcctgggcgagacccacggcagccacaacgagaccggccacaacaagaccgacgtgatgaccacccccggcgacaacctgagcagcgagcagcccgtgagcaccgccctgagcatcacccccgaccccagcaccgtgacccccaccacccccgccagcggcctggagggcagcggcgaggtgtacaccagcccccccatcatcaccgagagcctgagcctgcccgagaccacccccgagctgagcgccaccgccggcatcgacaccagcagcgccagcgacgtggacagcagcacccaggccgccagaggcaccagcgccctgaccgtgagaaccagcctgcccaacagccccagcacccccagcaccccccaggagacccaccaccccgtgagaaacctgctgagcgtgaccagccccagacccgaggagaccagcacccccagcggcagcggcaaggagagcagcgccaccagcggcccccaccccgtgagcaacaagccccccaccccccccgccaagacccagggccccaccgagaacaacagccacaacgccaccgagcaccccgagcccctgacccagagcgccaccctgggcctgatgaccagccccacccagatcgtgcacccccagagcgccaccagcatcaccgtgcaggacacctaccccagccccaccaacagaagcaagagaaacctggagatggagatcatcctgaccctgagccagggcctgaagaagtactacggcaagatcctgagactgctgagactgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcaagacccccggcaccctgagcaccaccgagagcacccccgccgagctgcccaccgccgagcccttcaagagctacttcgccaagggcttcctgagcatcgacagcggctactacagcgccaagtgctacagcggcaccagcaacagcggcctgcagctgatcaacatcaccagacacagcgccagaatcgtggacacccccggccccaaggtgaccaacctgaagaccatcaactgcatcaacctgaaggccagcatcttcaaggagcacagagaggtggagatcaacgtgctgctgccccaggtggccgtgaacctgagcaactgccacgtgatcatcaagagccacgtgtgcgactacagcctggacatcgacggcaccgtgagactgccccacatctaccacgagggcgtgttcatccccggcacctacaagatcgtgatcgacaagaaggacaagctgaacgacagatgcaccctgttcaccgactgcgtgatcaagggcagagaggtgagaaagggccagagcgtgctgagacagtacaagaccgagatcagaatcggcaaggccagcaccggcagcagaagactgctgagcgaggagaccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccatcagcctgagccccgtgcagagcgcccccatcagccacggcaagaccatcgaggcctacagagccagagagggctacaccagcatctgcctgttcgtgctgggcagcatcctgttcatcgtgagctacctgatgaagggcctggtggacagcgtgggcaacagcttcttccccggcctgagcatctgcaagacctgcagcaccagcagcatcaacggcttcgagatcgagagccacaagtgctactgcagcctgttctgctgcccctactgcagacactgcagcgccgacaaggagatccacaagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagaagaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagatcctggccgacagaagaatcgccgagctgttcagcaccaagacccacatcggctga

SEQ ID NO: 8712 - RNA, 5055 nt, synthetic construct
  misc_feature 1..5055: note = derived and/or modified CDS sequence (opt4) from CCHFV(UCCR4401)__KY484035.1__GP
  source 1..5055: mol_type = other RNA
atgcacatcagcctgatgtacgccatcctgtgcctgcagctgtgcggcctgggcgagacccacggcagccacaacgagaccagacacaacaagaccgacaccatgaccacccccggcgacaaccccagcagcgagccccccgtgagcaccgccctgagcatcaccctggaccccagcaccgtgacccccaccacccccgccagcggcctggagggcagcggcgaggtgtacaccagcccccccatcaccaccggcagcctgcccctgagcgagaccacccccgagctgcccgtgaccaccggcaccgacaccctgagcgccggcgacgtggaccccagcacccagaccgccggcggcaccagcgcccccaccgtgagaaccagcctgcccaacagccccagcacccccagcaccccccaggacacccaccaccccgtgagaaacctgctgagcgtgaccagccccggccccgacgagaccagcacccccagcggcaccggcaaggagagcagcgccaccagcagcccccaccccgtgagcaacagaccccccaccccccccgccaccgcccagggccccaccgagaacgacagccacaacagcaccgagcaccccgagagcctgacccagagcgccacccccggcctgatgaccagccccacccagatcgtgcacccccagagcgccacccccatcaccgtgcaggacacccaccccagccccaccaacagaagcaagagaaacctgaagatggagatcatcctgaccctgagccagggcctgaagaagtactacggcaagatcctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccccgccggcctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactacagcctggacatcgacggcgccgtgagactgccccacatctaccacgagggcgtgttcatccccggcacctacaagatcgtgatcgacaagaagaacaagctgaacgacagatgcaccctgttcaccgactgcgtgatcaagggcagagaggtgagaaagggccagagcgtgctgagacagtacaagaccgagatcagaatcggcaaggccagcaccggcagcagaagactgctgagcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgagaagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacagaagaatcgccgagctgttcagcaccaagacccacatcggctga

SEQ ID NO: 8713 - RNA, 5055 nt, synthetic construct
  misc_feature 1..5055: note = derived and/or modified CDS sequence (opt4) from CCHFV(IbAn7620)__KX013451.1__GP
  source 1..5055: mol_type = other RNA
atgcacatcagcctgatctacgccatcctgtgcctgcagctgtgcggcctgggcgagacctacggcagccacaacgagaccagacacaacaagaccgacaccatgaccacccccggcgacaacctgagcagcgagccccccgtgagcaccgccctgttcatcacccccgaccccagcaccgtgacccccaccacccccgccagcggcctggagggcagcggcgaggtgtacaccagcccccccatcaccaccggcagcctgcccctgcccgagaccacccccgagctgcccgccaccaccggcaccgacaccagcagcgccagcgacgtggacttcagcacccagaccgccggcggcaccagcgccctgaccgtgagaaccggcctgcccgacagccccagcacccccagcaccccccaggacacccaccaccccatgagaaacctgctgagcgtgaccagccccggccccgacgagaccagcacccccagcggcaccggcagagagagcagcgccaccagcagcccccaccccgtgagcaacagaccccccaccccccccgccaccgcccagggccccaccgagaacgacagccacaacgccaccgagcaccccgagagcctgacccagagcgccacccccggcctgatgaccagccccacccagaccatccacccccagagcgccacccccatcaccgtgcaggacaagcagcccagccccaccaacagaagcaagagaaacctggagatggagatcatcctgaccctgagccagggcctgaagaagtactacggcaagatcctgagactgctgcacctgaccctggaggaggacaccgagggcctgctggagtggtgcaagagaaacctgggcctggactgcgacgacaacttcttccagaagagaatcgaggagttcttcatcaccggcgagggccacttcaacgaggtgctgcagttcagaacccccggcaccctgagcaccaccgagagcacccccgccggcctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactacagcctggacatcgacggcgccgtgagactgccccacatctaccacgagggcgtgttcatccccggcacctacaagatcgtgatcgacaagaagaacaagctgaacgacagatgcaccctgttcaccgactgcgtgatcaagggcagagaggtgagaaagggccagagcgtgctgagacagtacaagaccgagatcagaatcggcaaggccagcaccggcagcagaagactgctgagcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgagatcgtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccagggcaagaccaccgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaaccccctgaacagcaccagcctggagaccagcctgagcatcgaggccccctggggcgccatcgacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccaacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8714 - RNA, 5055 nt, synthetic construct
  misc_feature 1..5055: note = derived and/or modified CDS sequence (opt4) from CCHFV(Zahedan 2007)__KC867273.1__GP
  source 1..5055: mol_type = other RNA
atgcacatcagcctgatgtacgccgtgttctgcctgcagctgtgcggcctgggcaagaccaacggcccccacaacggcaccgagcacaacaacacccacgtgatgaccacccccgacgacagccagagccccgagccccccgtgagcaccgccctgcccgtgacccccgaccccagcaccgtgacccccagcacccccgccagcggcctggagggcagcggcgaggtgcacaccagcagccccatcaccaccaagggcctgagcctgcccgaggccaccagcgagccccccagcaccaccagcgtggtgaccagcagcgccagcgacaccgacagcagcacccaggccgccggcgacacccccacccccaccgtgagaaccagcctgcccagcagccccagcacccccagcaccagccagggcacccactaccccgtgagaagcctgctgagcgtgaccggccccaagcccgaggagacccccacccccagcaagagcggcaaggacaacctggccaccaacagcccccaccccgccaccagcagacccaccacccccagcaccatcgcccagaagcccaccgagaacaacagccacaacaccaccgagcagctggagagcctgacccacctggccaccctgggcagcaagatcagccccacccagaccgtgctgccccagagcgtgaccagcatcgccatccaggacatccacaccagccccaccaacagaagcaagagaaacctggacatggagatcatcctgaccctgagccagggcctgaagaagtactacggcaagatcctgaagctgctgagactgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaaccctgggcaccctgagcaccaccgagagcacccacgccggcagccccaccgtggagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcaactgcatcaacctgaaggccagcgtgttcaaggagcacagagaggtggagatcaacgtgctgctgccccaggtggccgtgaacctgagcaactgccacgtggccatcaagagccacatctgcgactacagcctggacaccgacggcgccatcagactgccccagatccaccacgagggcaccttcatccccggcacctacaagatcgtgatcgacaagaagagcaagctgaacgacagatgcaccctgttcaccaactgcgtgatcaagggcagagaggtgagaaagggccagagcgtgctgagacagtacaagaccgagatcagaatcggcagagccagcaccggcagcagaagactgctgagcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggcttctgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggccacggcaagaccatcgagacctacagagtgagagaggagtacaccagcatctgcctgttcgtgctgggcagcatcctgttcatcgtgagcttcctgatgaagggcctggtggacggcgtgggcaacatcttcttccccggcctgagcgtgtgcaagacctgcagcatcggcagcatcaacggcttcgagatcgagagccacagatgctactgcagcctgttctgctgcccctactgcagacactgcagcgccgacggcgagatccaccagctgcacctgagcatctgcaagaagagaaagaccggcagcaacgtgatgctggccgtgtgcaagagaatgtgcttcagagccaccatggaggtgagcaacaaggtgctgttcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaaggacatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcttcttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggctga

SEQ ID NO: 8715 - RNA, 5055 nt, synthetic construct
  misc_feature 1..5055: note = derived and/or modified CDS sequence (opt4) from CCHFV(Afg09-2990)__HM452306.1__GP
  source 1..5055: mol_type = other RNA
atgcacatcagcctgatgtacgccgtgttctgcctgcagctgtgcggcctgggcaagaccaacggcccccacaacggcaccgagcacaacaacacccacgtgatgaccacccccgacgacagccagagccccgagccccccgtgagcaccgccctgcccgtgacccccgaccccagcaccgtgacccccagcacccccgccagcggcctggagggcagcggcgaggtgtacaccagcagccccatcaccaccaagggcctgagcctgcccgaggccaccagcgagccccccgccaccaccagcgtggtgaccagcagcgccagcgacaccgacagcagcacccaggccgccggcgacacccccacccccaccgtgagaaccagcctgcccagcagccccagcacccccagcaccagccagggcacccactaccccgtgagaagcctgctgagcgtgaccagccccaagcccgaggagacccccacccccagcaagagcggcaaggacaacctggccaccaacagcccccaccccgccaccagcagacccaccaccccccccaccaccgcccagaagcccaccgagaacaacagccacaacaccaccgagcagctggagagcctgacccacctggccaccctgggcagcatgatcagccccacccagaccgtgctgccccagagcgtgaccagcatcgccatccaggacatccacaacagccccaccaacagaagcaagagaaacctggacatggagatcatcctgaccctgagccagggcctgaagaagtactacggcaagatcctgaagctgctgcacctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaaccctgggcaccctgagcaccaccgagagcacccacgccggcagccccaccgtggagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcaactgcatgaacctgaaggccagcgtgttcaaggagcacagagaggtggagatcaacgtgctgctgccccaggtggccgtgaacctgagcaactgccacgtggccatcaagagccacatctgcgactacagcctggacaccgacggcgccatcagactgccccagatccaccacgagggcaccttcatccccggcacctacaagatcgtgatcgacaagaagagcaagctgaacgacagatgcaccctgttcaccaactgcgtgatcaagggcagagaggtgagaaagggccagagcgtgctgagacagtacaagaccgagatcagaatcggcagagccagcgccggcagcagaagactgctgagcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcactacctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggccacggcaagaccatcgagacctacagagtgagagaggagtacaccagcatctgcctgttcgtgctgggcagcatcctgttcatcgtgagcttcctgatgaagggcctggtggacggcgtgggcaacatcttcttccccggcctgagcgtgtgcaagacctgcagcatcggcagcatcaacggcttcgagatcgagagccacaagtgctactgcagcctgttctgctgcccctactgcagacactgcagcgccgacggcgagatccaccagctgcacctgagcatctgcaagaagagaaagaccggcagcaacgtgatgctggccgtgtgcaagagaatgtgcttcagagccaccatggaggtgagcaacaaggccctgttcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggctga

SEQ ID NO: 8716 - RNA, 5055 nt, synthetic construct
  misc_feature 1..5055: note = derived and/or modified CDS sequence (opt4) from CCHFV(SPU41/84)__AY900142.1__GP
  source 1..5055: mol_type = other RNA
atgcacatcagcctgatgtacgccgtgctgtgcctgcagctgtgcggcctgggcgagacccacggcagccacaacggcaccagatacaacaacaccgacgccaccaccacccccggcgacagccagagccccgagccccccgtgagcaccgccagcagcatcacccacaaccccagcaccgtgaccagcaccacccccaccagcggcagcgagggcagcggcgaggtgtacaccagcagccccatcaccaccgagggcctgagcccccccggcaccacccccgagctgcccgccaccaccggcatcgacaccagcggcgccagcgacgccaaccccagcacccaggccgccagaggcaccagcgccctgaccgtgcacaccagcctgcccagcagccccagcaccccccccatcagccaggacacccaccaccccgtgagaaacctgctgagcgtgaccagccccatgcccgaggagaccaccgcccccagcggcagcggcaaggagagcagcgccaccagcagcccccaccccgccagcgacagaccccccaccccccccgccaccgcccagggcctgaccgagagcaacagccacaacgccaccgagcacctggagagcctgacccagagcgccacccccggcctggtgaccagccccgcccagaccgtgcacccccacagcgccaccagcatcgccgcccccgacacccaccccaaccccaccaacagaagcaagagaaacctggagatggagatcatcctgaccctgagccagggcctgaagaagtactacggcaagatcctgagactgctgcacctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccgtgagcaccaccgagagcacccacgccggcccccccaccgccgagcccttcaagagctacttcgccaagggcagcctgagcatcgacagcggctactacagcgccaagtgctacagcggcaccagcaacagcggcctgcagctgatcaacatcaccagacacagcaccaagatcgccgacacccccggccccaagatcaccaacctgaagaccatcaactgcatcaacctgaaggccctgaccttcaaggagcacagagaggtggagatcaacgtgctgctgccccaggtggccgtgaacctgagcaactgccacgtggtgatcaagagccacgtgtgcgactacagcctggacatcgacggcaccgtgagactgccccacatccaccacgagggcatcttcatccccggcacctacaagatcgtgatcgacaagaagaacaagatgaacgacagatgcaccctgttcaccaactgcgtgatcaagggcagagaggtgagaaagggccagagcgtgctgaagcagtacaagaccgagatcagaatcggcaaggccagcaccggcagcagaagactgctgagcgaggagagcagcgacgactgcatcagcagaacccagctgctgagaaccgagaccgccgagatccacggcgacaactacggcggccccggcgacaagatcaccatctgcaacggcagcaccgtggtggaccagagactgggcagcgagctgggctgctacaccatcaacagagtgaagaccttcaagctgtgcgagaacagcgccaccggcaagagctgcgagatcgacagcgtgcccgtgaagtgcagacagggctactgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcatctgcaaggtgatcttctacctgctgatcatcgtgggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcagccacggcaagaccgtggaggcctacagagccagagagggctacaccagcatgtgcctgttcgtgctgggcagcgtgctgttcctggtgagctgcctgatgaagggcctggtggacagcgtgggcaacaccttcttccccggcctgagcatctgcaagacctgcagcatcagcagcatcaacggcttcgagatcgagagccacagatgctactgcagcctgttctgctgcccctactgcagacactgcagcgccaacaaggagatccaccagctgcacctgagcatctgcaagaagagaaaggccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgcctgcgtggtgagcaccagcgccgtggagatggagagcctgcccgccggcacctgggagagagaggaggacctgaccaacttctgccaccaggagtgccaggtggccgacaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctggtgcacaagatcgagccccacttcaacaccagctggatgagctgggacggctgcgacctggactactactgcaacatgggcgactggcccagctgcacctacaccggcgtgacccagcacaaccacgccagcttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcaccagcctgacctgcaccggctgctacgcctgcagcagcggcatcagctgcaaggtgagaatccacgtggacgagcccgacgagctgaccgtgcacgtgaagagcgaggaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtgaacaccaagctggagcagccccagagcatcctgatcgagagaaagggcaccatcatcggcaagcagaacaacacctgcaaggccaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaagaatcgccgagctgttcagcaccaagacccacatcggctga

SEQ ID NO: 8717 - RNA, 5055 nt, synthetic construct
  misc_feature 1..5055: note = derived and/or modified CDS sequence (opt4) from CCHFV(SPU103/87)__DQ211634.1__GP
  source 1..5055: mol_type = other RNA
atgcacatcagcctgatgtacgccgtgctgtgcctgcagctgtgcggcctgggcggcgcccacggcagccacaacggcaccagatacaacaacaccggcgccctgaccaccctgggcgacggccagagcagcgagccccccgtgagcaccgcccccagcaccacccacaaccccagcaccgtgaccagcaccacccccgccagcggcagcgagggcagcggcgaggtgtacaccgccagccccgtgaccaccgagggcctgagcccccccggcaccacccccgagctgcccgccaccaccggcatcgacaccagcggcgccagcgacgccgaccccagcacccaggccgccggcgacaccagcgccctgaccgtgagaaccagcctgcccagcagccccagcaccctgcccaccagccaggacacccaccaccccgtgagaaacctgctgagcgtgaccagccccagacccgaggagaccaccgcccccagcggcagcggcatcgagagcagcgccaccagcagcccccaccccgccagcgacagaccccccaccccccccgccgccgcccagggccccaccgagagcaacagccacaacgccaccgagcacctggagagcctgacccagagcgccacccccgacctggtgaccagccccgcccagaccgtgcacccccagagcgccaccagcatcgccgcccccgacacccaccccagccccaccaacagaagcaagagaaacctggaggtggagatcatcctgaccctgagccagggcctgaagaagtactacggcaagatcctgagactgctgcacctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccgtgagcaccaccgagagcacccacgccggcccccccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgccgacacccccggccccaagatcaccaacctgaagaccatcaactgcatcaacctgaaggccctgaccttcaaggagcacagagaggtggagatcaacgtgctgctgccccaggtggccgtgaacctgagcaactgccacgtggtgatcaagagccacgtgtgcgactacagcctggacatcgacggcaccgtgagactgccccacatccaccacgagggcatcttcatccccggcacctacaagatcgtgatcgacaagaagaacaagctgaacgacagatgcaccctgttcaccgactgcgtgatcaagggcagagaggtgagaaagggccagagcgtgctgaagcagtacaagaccgagatcagaatcggcaaggccagcaccggcagcagaagactgctgagcgaggagagcagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagaccttcaagctgtgcgagaacagcgccaccggcaagagctgcgagatcgacagcgtgcccgtgaagtgcagacagggctactgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcgtgctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaagactgctgcaggtgagcgagagcaccggcgtggccctgaagagaagcagctggctgatcgtgctgctggtgctgttcaccgtgagcctgagccccgtgcagagcgcccccatcagccacggcaagaccgtggaggcctaccaggccagagagggctacaccggcatgtgcctgttcgtgctgggcagcatcctgttcctggtgagctgcctgatgaagggcctggtggacagcgtgggcaacaccttcttccccggcctgagcatctgcaagacctgcagcatcagcagcatcaacggcttcgagatcgagagccacagatgctactgcagcctgttctgctgcccctactgcagacactgcagcgccaacaaggagatccaccagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgacaccgagtgcctgtgcccctacgaggccctggtgctgagaagacccctgttcctggacaacatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaagatcgagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgcccagcgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctggtgcacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcaccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtgaacaccaagctggagcagccccagagcatcctgatcgagcacaagggcaccatcatcggcaagcagaacaacacctgcaaggccagagccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaagaatcgccgagctgttcagcaccaagacccacatcggctga

SEQ ID NO: 8718 - RNA, 5055 nt, synthetic construct
  misc_feature 1..5055: note = derived and/or modified CDS sequence (opt4) from CCHFV(Iran-53)__DQ446216.1__GP
  source 1..5055: mol_type = other RNA
atgcacatcagcctgatgtacgccgtgttctgcctgcagctgtgcggcctgggcaagaccaacggcccccacaacggcaccgagcacaacaacacccacgtgatgaccacccccgacgacagccagagccccgagccccccgtgagcaccgccctgcccgtgacccccgaccccagcaccgtgacccccagcacccccgccagcggcctggagggcagcggcgaggtgtacaccagcagccccatcaccaccaagggcctgagcctgcccgaggccaccagcgagccccccgccaccaccagcgtggtgaccagcagcgccagcgacaccgacagcagcacccaggccgccggcggcacccccacccccaccgtgagaaccagcctgcccagcagccccagcacccccagcaccagccagggcacccactaccccgtgagaagcctgctgagcgtgaccagccccaagcccgaggagacccccacccccagcaagagcggcaaggacaacctggccaccaacagcccccaccccgccaccagcagacccaccgccccccccaccaccgcccagaagcccaccgagaacaacagccacaacaccaccgagcagctggagagcctgacccacctggccaccctgggcagcatgatcagccccacccagaccgtgctgccccagagcgtgaccagcatcgccatccaggacatccacaccagccccaccaacagaagcaagagaaacctggacgtggagatcatcctgaccctgagccagggcctgaagaagtactacggcaagatcctgaagctgctgcacctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaaccctgggcaccctgagcaccaccgagagcacccacgccggcagccccaccgtggagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcaactgcatcaacctgaaggccagcgtgttcaaggagcacagagaggtggagatcaacgtgctgctgccccaggtggccgtgaacctgagcaactgccacgtggccatcaagagccacatctgcgactacagcctggacaccgacggcgccatcagactgccccagatccaccacgagggcaccttcatccccggcacctacaagatcgtgatcgacaagaagagcaagctgaacgacagatgcaccctgttcaccaactgcgtgatcaagggcagagaggtgagaaagggccagagcgtgctgagacagtacaagaccgagatcagaatcggcagagccagcaccggcagcagaagactgctgagcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggccacggcaagaccatcgagacctacagagtgagagaggagtacaccagcatctgcctgttcgtgctgggcagcatcctgttcatcgtgagcttcctgatgaagggcctggtggacggcgtgggcaacatcttcttccccggcctgagcgtgtgcaagacctgcagcatcggcagcatcaacggcttcgagatcgagagccacaagtgctactgcagcctgttctgctgcccctactgcagacactgcagcgccgacggcgagatccaccagctgcacctgagcatctgcaagaagagaaagaccggcagcaacgtgatgctggccgtgtgcaagagaatgtgcttcagagccaccatggaggtgagcaacaaggccctgttcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggctga

SEQ ID NO: 8719 - RNA, 5055 nt, synthetic construct
  misc_feature 1..5055: note = derived and/or modified CDS sequence (opt4) from CCHFV(Iran-52)__DQ446215.1__GP
  source 1..5055: mol_type = other RNA
atgcacatcagcctgatgtacgccgtgttctgcctgcagctgtgcggcctgggcaagaccaacggcccccacaacggcaccgagcacaacaacacccacgtgatgaccacccccgacgacagccagagccccgagccccccgtgagcaccgccctgcccgtgacccccgaccccagcaccgtgacccccagcacccccgccagcggcctggagggcagcggcgaggtgtacaccagcagccccatcaccaccaagggcctgagcctgcccgaggccaccagcgagccccccgccaccaccagcgtggtgaccagcagcgccagcgacaccgacagcagcacccaggccgccggcgacacccccacccccaccgtgagaaccagcctgcccagcagccccagcacccccagcaccagccagggcacccactaccccgtgagaagcctgctgagcgtgaccagccccaagcccgaggagacccccacccccagcaagagcggcaaggacgacctggccaccaacagcccccaccccgccaccagcagacccaccaccccccccaccaccgcccagaagcccaccgagaacaacagccacaacaccaccgagcagctggagagcctgacccacctggccaccctgggcctgatgatcagccccacccagaccgtgctgccccagagcgtgaccagcatcgccatccaggacatccacaacagccccaccaacagaagcaagagaaacctggacatggagatcatcctgaccctgagccagggcctgaagaagtactacggcaagatcctgaagctgctgcacctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaaccctgggcaccctgagcaccaccgagagcacccacgccggcagccccaccgtggagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcaactgcatgaacctgaaggccagcgtgttcaaggagcacagagaggtggagatcaacgtgctgctgccccaggtggccgtgaacctgagcaactgccacgtggccatcaagagccacatctgcgactacagcctggacaccgacggcgccatcagactgccccagatccaccacgagggcaccttcatccccggcacctacaagatcgtgatcgacaagaagagcaagctgaacgacagatgcaccctgttcaccaactgcgtgatcaagggcagagaggtgagaaagggccagagcgtgctgagacagtacaagaccgagatcagaatcggcagagccagcaccggcagcagaagactgctgagcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggccacggcaagaccatcgagacctacagagtgagagaggagtacaccagcatctgcctgttcgtgctgggcagcatcctgttcatcgtgagcttcctgatgaagggcctggtggacggcgtgggcaacatcttcttccccggcctgagcgtgtgcaagacctgcagcatcggcagcatcaacggcttcgagatcgagagccacaagtgctactgcagcctgttctgctgcccctactgcagacactgcagcgccgacggcgagatccaccagctgcacctgagcatctgcaagaagagaaagaccggcagcaacgtgatgctggccgtgtgcaagagaatgtgcttcagagccaccatggaggtgagcaacaaggccctgttcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggaggagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggctga

SEQ ID NO: 8720 - RNA, 5055 nt, synthetic construct
  misc_feature 1..5055: note = derived and/or modified CDS sequence (opt4) from CCHFV(75024)__AB069671.1__GP
  source 1..5055: mol_type = other RNA
atgcacatcagcctgatgtgcgccgtgctgtgcctgcagctgtacggcctgggcgagacccacggcagcagcaacgagaccgagcacaacaagaccaacgtggtgaccacccccggcgacagccagagccccgagcccctggtgagcaccaccctgcccgtgaccctggacagcagcaccgtgacccccaccacccccgccagcggccccgagggcagcggcgaggtgtacaccagcccccccatcaccaccgagggcctgagccccagcgaggccaccagcgagctgcccgccaccaccggcatcggcatcagcagcgccagcgacgtggacagcagcacccaggccgccggcgacaccagcacccccaccgtgagaaccagcccccccaacagcagcagcaccccccccaccagccaggacacccaccaccccatgagaaacctgctgagcgtgaccagcctgaagcccgaggagaccagcgcccccagcaagagcggcaaggagagccccgccgccagcagcccccaccccgtggccagcagaccccccaccccccccaccaccgcccagggccccatcgagaacaacagccacaacaccaccggccagctggagagcgtgacccagagcgccaccctgggccccatggccagccccacccagaccgtgctgagccagaacgtgaccagcatcgccatccaggacacccaccccagccccaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccacgccgagagccccaccgccgagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacatcgacggcaccgtgagactgccccacatccaccacgagggcaccttcatccccggcacctacaagatcgtgatcgacaagaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgaggagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagcatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccatcagcctgagccccgtgcagagcgcccccatcggccacggcaagaccatcgagacctaccaggccagagaggagtacaccagcatctgcctgttcgtgctgggcagcatcctgttcatcgtgagctgcctgatgaagggcctggtggacagcatcggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgagaggcatgaagaaccagctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgatcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacctgatccacaagatcgagccccacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagttcacccccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacctgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8721 - RNA, 5055 nt, synthetic construct
  misc_feature 1..5055: note = derived and/or modified CDS sequence (opt4) from CCHFV(7803)__AB069672.1__GP
  source 1..5055: mol_type = other RNA
atgcacatcagcctgatgtgcgccgtgctgtgcctgcagctgtacggcctgggcgagacccacggcagcagcaacgagaccgagcacaacaagaccaacgtggtgaccacccccggcgacagccagagccccgagcccctggtgagcaccaccctgcccgtgaccctggacagcagcaccgtgacccccaccacccccgccagcgagcccgagggcagcggcgaggtgtacaccagcccccccatcaccaccgagggcctgagccccagcgaggccaccagcgagctgcccgtgaccaccggcatcggcatcagcagcgccagcgacgtggacagcagcacccaggccgccggcgacaccagcacccccaccgtgagaaccagcccccccaacagccccagcaccccccccaccagccaggacacccaccaccccatgagaaacctgctgagcgtgaccagcctgaagagcgaggagaccagcgcccccagcaagagcggcaaggagagccccgccgccagcagcccccaccccgtggccagcagaccccccacccaccccatcaccgcccagggccccaccgagaacaacagccacaacaccaccggccagctggagagcgtgacccagagcgccaccctgggccccatggccagccccacccagaccgtgctgagccagaacgtgaccagcatcgccatccaggacacccaccccagccccaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccacgccgagagccccaccgccgagcccttcaagagctacttcgccaagggcttcctgagcatcgacagcggctacttcagcgccaagtgctacagcagaaccagcgacagcggcctgcagctgatcaacgtgaccagacacagcaccagaatcgccgacacccccggccccaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacatcgacggcaccgtgagactgccccacatccaccacgagggcaccttcatccccggcacctacaagatcgtgatcgacaagaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgaggagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtgatcctggacgcctgcgacagcagctgcgaggtgatgatccccaagggcaccggcgacatcctggtggactgcagcggcggccagcagcacttcctgaaggacaacctgatcgacctgggctgccccagcatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccatcagcctgagccccgtgcagagcgcccccatcagccacggcaagaccatcgagacctaccaggccagagaggagtacaccagcatctgcctgttcgtgctgggcagcatcctgttcatcgtgagctgcctgatgaagggcctggtggacagcatcggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgcctgcaagagaatgtgcttcagagccaccatggaggtgagcaacaaggccctgctgatcagaagcatcatcaacaccaccttcgtggtgtacatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgagaggcatgaagaaccccctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgatcgtgaagtggaaggtggagtacatcaagaccagaggcatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacctgatccacaagatcgagccccacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagttcacccccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacttcttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8722 - RNA, 5055 nt, synthetic construct
  misc_feature 1..5055: note = derived and/or modified CDS sequence (opt4) from CCHFV(Hodzha)__AY223476.1__GP
  source 1..5055: mol_type = other RNA
atgcacatcctgctgatgtgcgccgtgctgtgcctgcagcagtacggcctgggcgagacccacagacccaacaacggcaccgagcacaacaagaccaacgtgctgaccacccccggcgacaagctgagccccgagctgcccgtgagcaccgccctgagcgtgacccccgacagcagcaccgtgacccccaccacccccgtgagcggcctggagggcagcggcgacgtgtacaccagcccccccgtgaccaccaagggcctgagccccagcaaggccaccagcgagctgcccgccagcagcggcatcgacaccagcagcgccagcgacgtggacagcagcacccaggccgccagagacaccagcaccctgaccgtgagaaccagcccccccagcagccccagcaccccccccaccagccaggacacctaccacctggtgagaaacctgctgagcgtgaccagcccctggcccgaggagaccaccgcccccagcaagagcggcaaggagagccccgtggccaacagcccccaccccgtgaccagcagacccagcagcccccccatcaccgtgcagggccccaccgagaacagcagccacaacaccaccggccagctggagagcatggcccagagcaccaccctggtgcccatggccagccccacccagaccgtgctgagccagagcgtgaccagcctggccgtgcaggacgcccaccccagccccaccaacagaagcaagagaaacctggagatggtgatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcaagacccccagcaccctgagcaccaccgagagcacccacgccgtgagccccaccgccgagcccttcaagagctacttcgccaagggcttcctgagcatcgacagcggctacttcagcgccaagtgctacagcaagaccagcaacagcggcctgcagctgatcaacgtgaccagacacagcaccagaatcgccgacacccccggccccaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacgtggacggcaccgtgagactgccccacatccaccacggcggcaccttcatccccggcacctacaagatcgtgatcgacaagaagaacaagctgaacgacagatgcaccctgtacaccaactgcgtgatcaagggcagagaggtgagaaagggccagagcatcctgagacagtacaagaccgagatcagaatcggcaaggccagcaccggcagcagaagactgctgagcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagagctgcgagatcgacagcacccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagaatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgttcgccgtgagcctgagccccgtgcagagcgcccccatcggccacggcaagaccatcgagacctaccaggccagagaggactacaccagcatctgcctgttcgtgctgggcagcatcctgttcatcgtgagctgcctgatgaagggcctggtggacagcatcggcaacatcttcttccccggcctgaccatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcaccaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagagaaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcaagtacaagcacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8723 - RNA, 5055 nt, synthetic construct
  misc_feature 1..5055: note = derived and/or modified CDS sequence (opt4) from CCHFV(Hodzha)__KX013448.1__GP
  source 1..5055: mol_type = other RNA
atgcacatcctgctgatgtgcgccgtgctgtgcctgcagcagtacggcctgggcgagacccacagacccaacaacggcaccgagcacaacaagaccaacgtgctgaccacccccagcgacaagctgagccccgagccccccgtgagcaccgccctgagcgtgacccccgacagcagcaccgtgacccccaccacccccgtgagcggcctggagggcagcggcgaggtgtacaccagcccccccgtgaccaccaagggcctgagccccagcaaggccaccagcgagctgcccgccaccaccggcatcgacaccagcagcgccagcgacgtggacagcagcacccaggccgccagagacaccagcaccctgaccgtgagaaccagcccccccagcagccccagcaccccccccaccagccaggacacctaccacctggtgagaaacctgctgagcgtgaccagccccagacccgaggagaccaccgcccccagcaagagcggcaaggagagccccgtggccaacagcccccaccccgtgaccagcagacccagcagcccccccatcaccgtgcagggccccaccgagaacagcagccacaacaccaccggccagctggagagcatggcccagagcaccaccctggtgcccatggccagccccacccagaccgtgctgagccagagcgtgaccagcctggccgtgcaggacgcccaccccagccccaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcaagacccccagcaccctgagcaccaccgagagcacccacgccgtgagccccaccgccgagcccttcaagagctacttcgccaagggcttcctgagcatcgacagcggctacttcagcgccaagtgctacagcaagaccagcaacagcggcctgcagctgatcaacgtgaccagacacagcaccagaatcgccgacacccccggccccaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacgtggacggcaccgtgagactgccccacatccaccacggcggcaccttcatccccggcacctacaagatcgtgatcgacaagaagaacaagctgaacgacagatgcaccctgtacaccaactgcgtgatcaagggcagagaggtgagaaagggccagagcatcctgagacagtacaagaccgagatcagaatcggcaaggccagcaccggcagcagaagactgctgagcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagaatccccctgctgggcaagatggccatctacatctgcagaatgagcaaccaccccgagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgttcgccgtgagcctgagccccgtgcagagcgcccccatcggccacggcaagaccatcgagacctaccaggccagagaggagtacaccagcatctgcctgttcgtgctgggcagcatcctgttcatcgtgagctgcctgatgaagggcctggtggacagcatcggcaacatcttcttccccggcctgaccatctgcaagacctgcagcatcggcagcatcaacggcttcgagatcgagagccacaagtgctactgcagcctgctgtgctgcccctactgcagacactgccccgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcaagaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgcagcgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcagaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcaagtacaagcacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8724 - RNA, 5055 nt, synthetic construct
  misc_feature 1..5055: note = derived and/or modified CDS sequence (opt4) from CCHFV(Baghdad 12)__AJ538197.2__GP
  source 1..5055: mol_type = other RNA
atgcacatcagcctgatctacgccgtgctgtgcctgcagctgtacggcctgggcgagacccacggcagcagcagcggcaccgagcacaacagaaccaacgtggtggccacccccggcggcagccagagccccgagcccctggtgagcaccaccctgcccgtgaccctggacagcagcaccgtgacccccgccacccaggccagcggccccgagggcagcggcgaggtgtacaccagcccccccaccaccaccgagggcctgagccccagcgacgccaccagcgagctgcccaccaccaccggcatcggcatcagcagcagcagcgacgtgaacagcagcacccaggccgccggcgacaccagcacccccaccgccagaaccagcctgcccgacagccccagcaccccccccaccagccaggacacccaccaccccatgagaaacctgctgagcgtgaccagcctgaagcccgaggagacccccgcccccagcaagagcggcaaggagagccccgccgccagcagcccccaccccgtggccagcagaccccccacccccagcaccaccgcccagggccccaccgagaacaacagcagaaacaccaccgtgcagctgaagagcgtgacccagagcgccaccctgggccccatggccagccccacccagaccgtgctgctgcagagcgtgaccagcatcgccatccaggacacccaccccagccccaccaacagaagcagaagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccacgccggcagccccaccgtggagcccttcaagagctacttcgccaagggcttcctgctgatcgacagcggctacttcagcgccaagtgctacagcagaaccagcaacagcggcctgcagctgatcaacgtgaccagacacagcaccaagatcgccgacacccccggccccaagatcaccaacctgaagaccatcagctgcatcaacctgaaggccagcatcttcaaggagcacagagagatcgagatcaacgtgctgctgccccaggtggccgtgaacctgagcaactgccacgtgaccatcaagagccacgtgtgcgactacagcctgaacatcgacggcaccgtgaagctgccccacatccaccacgagggcatcttcatccccggcacctacaagatcgtgatcgacaagaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgaggagagcggcgacgactgcatcagcagaaccagactgctgagaaccgagaccgccgagatccacggcgacagctacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcaagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctggccgtgagcagcagccccgtgcagagcgcccccatcggctacggcaagaccatcgagacctaccaggccagagagggctacaccagcatctgcctgttcgtgctgggcagcatcctgttcatcgtgagctgcctgaccaagggcctggtggacagcatcggcaacatcttcttccccggcctgagcatctgcaagacctgcagcatcggcagcatcaacggcttcgaggtggagagccacaagtgctactgcagcctgctgtgctgcccctactgcagacactgcagcgccgacagagagatccaccagctgcacctgagcatctgcaagaagagaaagaccggcagcagcgtgatgctggccgtgtgcaagagaatgtgcttcagagccaccatggaggtgagcaacaaggccctgctgatcagaagcatcatcaacaccaccttcgtggtgtgcatcctgaccctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaccaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgacgccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggtgagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacttcttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8725 - RNA, 5055 nt, synthetic construct
  misc_feature 1..5055: note = derived and/or modified CDS sequence (opt4) from CCHFV(TADJ/HU8966 )__AY179962.1__GP
  source 1..5055: mol_type = other RNA
atgcacatgctgctgatgtgcgccgtgctgtgcctgcagctgtacggcctgggcggcaccctgagaagcaacaacggcaccgagcacaacaagaccaacgtgctgaccacccccggcgacaagctgagccccgagccccccgtgagcaccgccctgcccgtgacccccgacagcagcaccgtgacccccaccacccccgccagcggcctggagggcagcggcgaggtgtacaccagcccccccatcaccaccaagggcctgagccccagcgaggccaccagcgagccccccgccaccaccggcatgggcatcagcagcgccagcggcgtggacttcagcacccaggccgccagagacaccagcaccctgaccgtgctgaccagcccccccaacagccccaacaccccccccaccagccaggacacccaccaccccgtgagaagcctgctgagcgtgaccagccccagacccgaggagaccaccgcccccagcaagagcggcaaggagagccccgccgccaacagcagccaccccgtgaccagcagacccagcagccccctgatcaccgtgagaggccccaccgagaacagcagccacaacaccaccggccagctggagagcatgacccagagcaccaccctggtgcccatggccagccccacccagaccgtgctgagccagagcgtgaccagcatcgccgtgcaggacgcccaccccagcagcaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccacgccggcagccccaccgccgagcccttcaagagctacttcgccaagggcttcctgagcatcgacagcggctacttcagcgccaagtgctacagcagaaccagcaacagcggcctgagactgatcaacgtgaccagacacagcaccagaatcgccgacacccccggccccaagatcaccaacctgaagaccatcagctgcatcaacctgagagccagcatcttcaaggagcacagagaggtggagatcaacgtgctgctgccccaggtggccgtgaacctgagcaactgccacgtggccatcaagagccacgtgtgcgactacagcctggacgtggacggcaccgtgagactgccccacatccaccacggcggcaccttcatccccggcacctacaagatcgtgatcgacaagaagaacaagctgaacgacagatgcaccctgttcaccaactgcgtgatcaagggcagagaggtgagaaagggccagagcatcctgagacagtacaagaccgagatcagaatcggcaaggccagcaccggcagcagaagactgctgagcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcagcgtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcaccagaatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagagagtggaggagaccgagctgtacctgaacctggagagaatcccctggatcgtgagaaagctgctgcaggtgagcgagagcaccggcgtggccctgaagagaagcagctggctgatcgtgctgctggtgctgttcaccgtgagcctgagccccgtgcagagcgcccccatcggctacggcaacaccatcgagacctaccaggccagagaggagtacaccagcatctgcctgttcgtgctgggcagcatcctgttcatcgtgagctgcctgatgaagggcctggtggacagcatcggcaacatcttcttccccggcctgaccatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcatcgtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaaccccctgaacagcaccagcctggagaccagcctgagcatcgaggccccctggggcgccatcaacgtgcagagcacctacaagcccaccgtgagcaccgccaacatcgccctgagctggagcagcatcgagcacagaggcaacaacatcctggtgagcggcagaagcgagagcatcatgaagctggaggagagaaccggcatcagcggcgacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcatcgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggagaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtacagaaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgagctgcttcaagtgctgcagaagaaccagaggcctgctgaagcacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8726 - RNA, 5055 nt, synthetic construct
  misc_feature 1..5055: note = derived and/or modified CDS sequence (opt4) from CCHFV(K168_40)__KX013457.1__GP
  source 1..5055: mol_type = other RNA
atgcacatcagcctgatgtgcgccgtgctgtgcctgcagctgtacggcctgggcggcacccacggcctgcacaacggcaccgagcacaacaagaccaacgccgtgaccaccagcagcaacagccagagcagcgagagccccgccagaaccgccccccccgtgacccccgacagccccaccgtgacccccaccacccccgccagcgcccccgagggcagcggcgaggcccacagcagcccccccaacaacaccgagggccccagcctgcccgagagcaccagcgagccccccgccgccaccagcaccggcatccccagcgccagcgacgtgaacagcagcacccaggccgccagagacaccagcacccccaccgtgagaaccagcccccccaacagccccagcaccccccccaccccccaggagacccaccaccccgtgagaaacctgctgagcgtgaccagccacaagcccgaggagaccagcgcccccagcgagagcggcaaggagagccccgccgccaacagcccccaccccgtggccagcagaccccccacccccagcaccaccgcccagggccccaccgagaacaacaactacaacaccaccggccagctggagagcctgacccagagcaccaccctgggccccatgaccagcctgacccagaccgacctgccccagagcgtgaccagcatcgccgtgcaggacacccaccccagccccaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccacgccggcctgcccaccgccgagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacatcgacggcaccgtgagactgccccacatccaccacgacggcaccttcatccccggcacctacaagatcgtgatcgacagaaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgaggtggacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcggccacggcaagaccatcgagacctaccaggtgagagaggagtacaccagcatctgcctgttcgtgctgggcagcatcctgttcatcgtgagctgcctgatgaagggcctggtgaacagcgtgggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccgtggaggtgagcaacaaggccctgagcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacggcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcatcaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8727 - RNA, 5055 nt, synthetic construct
  misc_feature 1..5055: note = derived and/or modified CDS sequence (opt4) from CCHFV(K128_76)__KX013454.1__GP
  source 1..5055: mol_type = other RNA
atgcacatcagcctgatgtgcgccgtgctgtgcctgcagctgtacggcctgggcggcacccacggcagccacaacgagaccgagcacaacaagaccaacgccgtgaccaccagcagcgacagccagagccccgagccccccaccagaaccaccctgcccgtgacccccgacagccccaccgtgacccccaccacccccgccagcgcccccgagggcagcggcgaggtgcacaccagcccccccaacaccaccgagggccccagcctgcccgagagcacccccgagccccccaccgccaccagcaccggcatccccagcgccagcgacgtgaacagcagcacccaggccgccagagacaccagcacccccaccgtgcacaccagcccccccaacagccccagcaccccccccaccctgcaggagacccaccaccccatgagaaacctgctgagcgtgaccagccacaagcccgaggagaccagcgcccccagcgagagcggcaaggagagccccgccgccaacagcccccaccccgtggccgacagacccagcaccagcagcaccaccgcccagggccccaccgagaacaacagctacaacaccaccgagcagctggagagcctgacccagagcaccaccctgggccccatgaccagcctgacccagaccgtgctgagccagagcgtgaccagcatcgccgtgcaggacacccacctgagccccaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctggacctggactgcgacgacaccttcttccagaagagaatcgaggagttcttcatcaccggcgagggctacttcaacgaggtgctgcagttcagaacccccggcaccctgagcaccaccgagagcacccacgccggcctgcccaccgccgagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggccccaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacatcgacggcaccgtgaagctgccccacatccaccacgacggcaccttcatccccggcacctacaagatcgtgatcgacagaaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcagccacggcaagaccatcgagacctaccaggtgagagaggagtacaccagcatctgcctgttcgtgctgggcagcatcctgttcatcgtgagctgcctgatgaagggcctggtgaacagcgtgggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgttcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttccaggacagcatcgtgaagggcatgaagaacctgctgaacagcaccagcctggagaccagcctgagcatcgaggccccctggggcgccatcaacgtgcagagcacctacaagcccgccgtgagcgccgccaacatcgccctgagctggagcagcgtggagcacagaggcagcaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggagaacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8728 - RNA, 5055 nt, synthetic construct
  misc_feature 1..5055: note = derived and/or modified CDS sequence (opt4) from CCHFV(K168_125)__KX013460.1__GP
  source 1..5055: mol_type = other RNA
atgcacatcagcctgatgtgcgccgtgctgtgcctgcagctgtacggcctgggcggcacccacggcctgcacaacggcaccgagcacaacaagaccaacgccgtgaccaccagcagcaacagccagagcagcgagagccccgccagaaccgccccccccgtgacccccgacagccccaccgtgacccccaccacccccgccagcgcccccgagggcagcggcgaggcccacagcagcccccccaacaacaccgagggccccagcctgcccgagagcaccagcgagccccccgccgccaccagcaccggcatccccagcgccagcgacgtgaacagcagcacccaggccgccagagacaccagcacccccaccgtgagaaccagcccccccaacagccccagcaccccccccaccccccaggagacccaccaccccgtgagaaacctgctgagcgtgaccagccacaagcccgaggagaccagcgcccccagcgagagcggcaaggagagccccgccgccaacagcccccaccccgtggccagcagaccccccacccccagcaccaccgcccagggccccaccgagaacaacaactacaacaccaccggccagctggagagcctgacccagagcaccaccctgggccccatgaccagcctgacccagaccgacctgccccagagcgtgaccagcatcgccgtgcaggacacccaccccagccccaccaacagaagcaagagaaacctggagatggagatcatcctgaccctgccccagggcctgaagaagtactacggcaaggtgctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccacgccggcctgcccaccgccgagcccttcaagagctacttcgccaagggcttcctgagcatcgacagcggctacttcagcgccaagtgctacagcagaaccagcaacagcggcctgcagctgatcaacgtgaccagacacagcaccagaatcgccgacacccccggcctgaagatcaccaacctgaagaccatcagctgcatcaacctgaaggccagcgtgttcaaggagcacagagaggtggagatcaacgtgctgctgccccaggtggccgtgaacctgagcaactgccacgtgaccatcaagagccacgtgtgcgactacagcctggacatcgacggcaccgtgagactgccccacatccaccacgacggcaccttcatccccggcacctacaagatcgtgatcgacagaaagaacaagctgaacgacagatgcaccctgttcaccaactgcgtgatcaagggcagagaggtgagaaagggccagagcgtgctgagacagtacaagaccgagatcagaatcggcaaggccagcaccggcagcagaagactgctgagcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgaggtggacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaaggtgcccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcggccacggcaagaccatcgagacctaccaggtgagagaggagtacaccagcatctgcctgttcgtgctgggcagcatcctgttcatcgtgagctgcctgatgaagggcctggtgaacagcgtgggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccgtggaggtgagcaacaaggccctgagcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcaagaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcatcaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggaggacgacgaggagaccggctacagaagaatcatcgagagactgaacaacaagaagggcaagaacaagctgctggacggcgagagactggccgacagaagaatcgccgagctgttcagcaccaagacccacatcggctga

SEQ ID NO: 8729 - RNA, 5052 nt, synthetic construct
  misc_feature 1..5052: note = derived and/or modified CDS sequence (opt4) from CCHFV(Kosova Hoti)__EU037902.1__GP
  source 1..5052: mol_type = other RNA
atgcacaccctgctggtgtgcttcatcctgtacctgcagctgctgggcctgggcggcgcccacggccagagcaacgccaccgagcacaacggcaccaacaccaccaccgcccccggcaccagccagagccccaagccccccgccagcaccacccccagccacgcccccgagcccagcaccatcaagctgaccacccccaccagcgagaccgagggcagcggcgagaccaccccccccaccaacaccacccaggacagcccccccctggagaccacccccgagagaagcgccaccaccgccaccagcaccagcggcaccgacaacatgaacagcaccacccagatgaccgacaacacccccaccagcaccgtgagcaccagcctgagcagcagccccagcacccccagcaccagccagggcatgcaccaccccgtgagaagcctgctgagcgtgagcagccccaagaccgccaccacccccacccccatgagccccggcgagatgagcagcgagaccagcagccagcacagcgccatgagcagaacccccaccccccacaccgccacccaggtgagcaccgagaacgccaacagaagcaccagcagacagagcgagagcagcgcccagcccgccacccagagccccgtgaccagccccgcccagagcatcctgctgatgagcgccacccccaccaccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcacccccagcagcaccgagcccagccacgccagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatgcccggcacctacaagatcgtgatcgacagaaagaacaagctgaacgacagatgcaccctggtgaccaactgcgtgatcaagggcagagaggtgagaaagggccagagcgtgctgagacagtacaagaccgagatcaagatcggcaaggcccccaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccagaagggcagaggccacgtgaagctgagcagaggcagcgaggtggtgctggacgcctgcgacagcaactgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccaagaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgaagcagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgaacatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgcccccagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccggcaccagcctgatggccagaaagctggagttcggcaccgacagcaccttcaaggccttcagcgccatgcccaagaccagcctgtgcttctacatcgtggagaaggagtactgcaagagctgcagcgaggacgacaccaagaagtgcgtggacaccaagctggagcagccccagagcatcctgatcgagcacagaggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8730 - RNA, 5049 nt, synthetic construct
  misc_feature 1..5049: note = derived and/or modified CDS sequence (opt4) from CCHFV(Oman)__DQ211632.1__GP
  source 1..5049: mol_type = other RNA
atgcacaccctgctggtgtacgccgtgttctgcctgcagctgtggagccccggcggcaccagaggcctgagcaacgagacccagcacaacgagaccggcatcaccagagcccccgagggcagccagggccccagcctgcccgtgagcaccgccagccccatcatgagcgaccccagcatcaccacccccagcgccagcaccagcggcctggagggcagcggcgacaccaccccccccgccatcacccagggccccaccccccccgagaccacccccgagcccagcaccaccaccggcaccaacgccttcagcaccgccatcgccaacgtgagcacccagaccgtgaaggacacccccacccccaccgtgcagaccagcccccccagcacccccgacgccagcaccatcccccagggcacccaccacaccgccagaggcctgctgagcgtgaccgtgaccaagcccgaggaggtgcccacccccaccggccccgagcaggccagcatcgagaccaacagccccagactggccaccagcaagacccccagccccagccccaccgcccaggtgaccaccgagaacagcaaccccaacaccagcagacagctggtgctgagcacccagcccgccaccagcagccccgtgaccagccccgcccagctgatcttcgtgcagagcgccaccaccgtggccgtgcaggacgcccaccccagccccaccaacagaagcaagagaaacctggagatggaggtgatcctgaccctgagccagggcctgagaaagtactacggcagaatcctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagcagcaccgagagcgccagcgtgggcctgcccaccgtggagcccttcaagagctacttcgccaagggcttcctgagcatcgacagcggctacttcagcgccaagtgctaccccagagccagcaacagcggcctgcagctgatcaacgtgacccagcacagcgccagaatcgccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgcacatcaagagccacgtgtgcgactacagcctggacatcgacggcaccgtgagactgcccagaatccaccacgagggcaccttcatccccggcacctacaagatcgtgatcgacaagaagaacaagcagaacgacagatgcaacctggtgaccaactgcgtgatcaagggcagagaggtgagaaagggccagagcgtgctgagacagtacagaaccgagatcagaatcggcaaggccagcagcggcagcagaagactgctgagcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacaccagcatctgcctgttcgtgctgggcagcatcctgttcatcgtgagccacctgatgaagggcctggtggacagcgtgggcaacagcttcttccccggcctgagcatctgcaagacctgcagcatcggcagcatcaacggcttcgagatcgagagccacaagtgcttctgcagcctgttctgctgcccctactgcagacactgcagcgccgacaaggagatccacaagctgcacctgagcatctgcaagaagagaaaggccggcagcaacgtgatgctggccgtgtgcaagagaatgtgcttcagagccaccatggaggtgagcaacaaggccctgctgatcagaagcgtgatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8731 - RNA, 5049 nt, synthetic construct
  misc_feature 1..5049: note = derived and/or modified CDS sequence (opt4) from CCHFV(Oman_812956)__KY362518.1__GP
  source 1..5049: mol_type = other RNA
atgcacaccctgctggtgtacgccgtgttctgcctgcagctgtggagccccggcggcaccagaggcctgagcaacgagacccagcacaacgagaccggcatcaccagagcccccgagggcagccagggccccagcctgcccgtgagcaccgccagccccatcatgagcgaccccagcatcaccaccctgagcgccagcaccagcggcctggagggcagcggcgacaccaccccccccgccatcacccagggccccaccctgcccgagaccacccccgagcccagcaccaccaccggcaccaacgccttcagcaccgccatcgccaacgtgagcacccagaccgtgaaggacacccccacccccaccgtgcagaccagcccccccagcacccccgacgccagcaccatcccccagggcacccaccacaccgccagaggcctgctgagcgtgaccgtgaccaagcccgaggaggtgcccacccccaccggccccgagcaggccagcatcgagaccaacagccccagactggccaccagcaagacccccagccccagccccaccgcccaggtgaccaccgagaacagcaaccccaacaccagcagacagctggtgctgagcacccagcccgccaccagcagccccgtgaccagccccgcccagctgaacttcgtgcagagcgccaccaccatcgccgtgcaggacgcccaccccagccccaccaacagaagcaagagaaacctggagatggaggtgatcctgaccctgagccagggcctgagaaagtactacggcagaatcctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagccccaccgagagcgccagcgtgggcctgcccaccgtggagcccttcaagagctacttcgccaagggcttcctgagcatcgacagcggctacttcagcgccaagtgctaccccagagccagcaacagcggcctgcagctgatcaacgtgacccagcacagcgccagaatcgccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgcacatcaagagccacgtgtgcgactacagcctggacatcgacggcaccgtgagactgcccagaatccaccacgagggcaccttcatccccggcacctacaagatcgtgatcgacaagaagaacaagcagaacgacagatgcaacctggtgaccaactgcgtgatcaagggcagagaggtgagaaagggccagagcgtgctgagacagtacagaaccgagatcagaatcggcaaggccagcagcggcagcagaagactgctgagcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacaccagcatctgcctgttcgtgctgggcagcatcctgttcatcgtgagccacctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacaaggagatccacaagctgcacctgagcatctgcaagaagagaaaggccggcagcaacgtgatgctggccgtgtgcaagagaatgtgcttcagagccaccatggaggtgagcaacaaggccctgctgatcagaagcgtgatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcttcgacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8732 - RNA, 5049 nt, synthetic construct
  misc_feature 1..5049: note = derived and/or modified CDS sequence (opt4) from CCHFV(Oman-199809166)__KR864901.1__GP
  source 1..5049: mol_type = other RNA
atgcacaccctgctggtgtacgccgtgttctgcctgcagctgtggagccccggcggcaccagaggcctgagcaacgagacccagcacaacgagaccggcatcaccagagcccccgagggcagccagggccccagcctgcccgtgagcaccgccagccccatcatgagcgaccccagcatcaccaccctgagcgccagcaccagcggcctggagggcagcggcgacaccaccccccccgccatcacccagggccccaccctgcccgagaccacccccgagcccagcaccaccaccggcaccaacgccttcagcaccgccatcgccaacgtgagcacccagaccgtgaaggacacccccacccccaccgtgcagaccagcccccccagcacccccgacgccagcaccatcccccagggcacccaccacaccgccagaggcctgctgagcgtgaccgtgaccaagcccgaggaggtgcccacccccaccggccccgagcaggccagcatcgagaccaacagcagcagactggccaccagcaagacccccagccccagccccaccgcccaggtgaccaccgagaacagcaaccccaacaccagcagacagctggtgctgagcacccagcccgccaccagcagccccgtgaccagccccgcccagctgaacttcgtgcagagcgccaccaccatcgccgtgcaggacgcccaccccagccccaccaacagaagcaagagaaacctggagatggaggtgatcctgaccctgagccagggcctgagaaagtactacggcagaatcctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagccccaccgagagcgccagcgtgggcctgcccaccgtggagcccttcaagagctacttcgccaagggcttcctgagcatcgacagcggctacttcagcgccaagtgctaccccagagccagcaacagcggcctgcagctgatcaacgtgacccagcacagcgccagaatcgccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgcacatcaagagccacgtgtgcgactacagcctggacatcgacggcaccgtgagactgcccagaatccaccacgagggcaccttcatccccggcacctacaagatcgtgatcgacaagaagaacaagcagaacgacagatgcaacctggtgaccaactgcgtgatcaagggcagagaggtgagaaagggccagagcgtgctgagacagtacagaaccgagatcagaatcggcaaggccagcagcggcagcagaagactgctgagcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacaccagcatctgcctgttcgtgctgggcagcatcctgttcatcgtgagccacctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacaaggagatccacaagctgcacctgagcatctgcaagaagagaaaggccggcagcaacgtgatgctggccgtgtgcaagagaatgtgcttcagagccaccatggaggtgagcaacaaggccctgctgatcagaagcgtgatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8733 - RNA, 5055 nt, synthetic construct
  misc_feature 1..5055: note = derived and/or modified CDS sequence (opt4) from CCHFV(BA66019)__AF350448.1__GP
  source 1..5055: mol_type = other RNA
atgtacaccctgctggtgtgcgccgtgctgtgcccccagctgtggagcctggagggcacccacgtgccccacaacgagaccaagcacaacggcaccggcatcaccgccgcccccggcgagagccagggccccatgagccccgccagcaccgccgtgcccctgacccccgagccccccaacaccaagcccgccgccagcgccagcgagctggagagcagcggcgagggccacaccagcctgctggccaccacccagggcctgaccagccccgaggccacccccgagctgcccaccaccaccgacaccggcgtgagcagcaccagcgtggtggacatcggcacccagatggccaaggacacccccaccagcaccgcccacaccagcctgcccagcaaccccagcgcccccagcaccgcccagggcacccaccacaccatcagaggcctgctgagcgtgaccagcaccaagcccgaggaggccagcacccccaccgaccccggcaaggccggcgccgagaccggcagccccagacccgccatcagcagaaagcccaccctgagccccaccgccgaggcccccaccgagatcaacaacagcagcacccccaagcagcccgagcccagcatccagcccgccacccccagcctggtgatcagccccgcccagcccgccttcccccagagcgccaccagcaccgccgcccaggacatctacagcagccccaccaacagaagcaagagaaacctgaagatggagatcatcctgaccctgagccagggcctgaagaagtactacggcaagatccagaagaccctgggcctgaccctggaggaggacaccgagggcctgctggagtggtgcaagagaaacctgggcctgacctgcgacgacaacttcttccagaagagaatcgaggagttcttcctgaccggcgagggctacttcaacgaggtgctgcagttcaagacccccagcacccccggcagcaccgagcccacccacgccgaggcccccaccgtgaagcccttcaagagctacttcgccagaggcttcctgaccatcaacagcggctacttcagcgccaagtgctacagctggaccagcaacagcggcctgcagctgatcaacgtgacccagcaccccgccagaatcgccgacacccccggccccaagatcaccaacctgaagaccatcaactgcatcaacctgaaggccagcgtgttcaaggagcacagagagatcgagatcaacgtgctgctgccccaggtggccgtgaacctgagcaactgccacgtgctgatcaagagccacgtgtgcgactacagcctggacatcgacggcaccatcagactgcccagaatctaccacgagggcaccttcatccccggcacctacaagatcgtgatcgacaagagagacaagcagaacgacagatgcaccctggtgaccaactgcgtgatcaagggcagagaggtgagaaagggccagagcgccctgagacagtacagaaccgagatcagaatcggcaaggccagcgccggcagcagaagactgctgagcgaggagagcggcgacgactgcatcagcagaacccagctgctgagaaccgagaccgccgaggtgcacggcgacaactacggcggccccggcgacaagatcaccatctgcaacggcagcaccatcgtggaccagagactgggcagcgagctgggctgctacaccatcaacagagtgaagagcttcaagctgtgcgagaacagcggcaccggcaagagctgcaagatcgacaagcaccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcttctgcaagatcatcttctacctgctgatcgtggtgggcaccctgggcaagaagttcaagcagtacagagagctgaagccccagacctgcaccatctgcgagaccacccccaccaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgaggcctaccagaccagagagggctacaccagcgtgtgcctgttcatgctgggcggcatcctgttcgtggtgagctgcctgatgaagggcctggtggacagcgtgagcaacagcttcttccccggcctgagcatctgcaagacctgcagcatcggcagcgtgaacggcttcgagatcgagagccacaagtgctactgcagcctgctgtgctgcctgtactgcagacactgcagcgccgacagagagatccaccagctgcacctgagcatctgcaagaagagaagagccggcggcaacgtgatgctggccgtgtgcaagagaatgtgcctgagagccaccatggaggtgagcaacaaggtgctgttcatcagaagcatcatcaacaccaccttcgtgatctgcatcctggtgctggccgtgtgcatcgtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgacagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaacagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgccatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagatacctgaaggacgacgaggagagcggctacagaagaatcatcgagagactgaacaacaagaagggcaagaacaagctgctggacggcgagagactggccgacagaagaatcgccgagctgttcagcaccaagacccacatcggctga

SEQ ID NO: 8734 - RNA, 5055 nt, synthetic construct
  misc_feature 1..5055: note = derived and/or modified CDS sequence (opt4) from CCHFV(SPU 18/88)__KJ682810.1__GP
  source 1..5055: mol_type = other RNA
atgtacacccccctgctgtgcgccatcctgtgcctgcagctgtggagcctggagggcatctacggcctgagcaacaagacccagcacaacgacaccagcaccatcaaggtgcccgaggagagccagaagaccagcctgcccgccaacaccgccagccccatcaccagcgaccccagcagcgccaccagcaccgccctggccagcggccccgagggcagcggcgacaccagcaccagccccagcgtgaccacccagggccccaccctgctggagaccacccccgagccccacaccaccatcgacatcgacgagagcagcaccgccatcgccgacatcagcacccagaccgtgaaggacatccccacccccaccacccacaccagcctgcccagcacccccagcgcccccaccatcccccaggaggcccaccacaccgccagaggcctgctgagcgtgaccagcaccaagcccggcgagaccagcacccccaccagccccggcgaggccagcaccgaggccagcagcccccagcccaccatcagcgagacccccagccccccccccaccacccaggcccccaccgagatcaacaaccccaacaccagcagacagcccatgcccagcacccagcccgccgcccccaacagcgtgaccccccccgtgcagcccaccttcagccagagcgacgtgagcaccgtggcccaggacatccaccccagccccaccaacagaagcaagagaaacctggagatggagatcatcctgaccctgagccagggcctgaagaagtactacggcaaggtgctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagccccaccgagcccgccagagtggagagccccaccgtggagcccttcaagagctacttcgccaagggcttcctgagcatggacagcggctacttcagcgccaagtgctaccccaagagcagcaacagcggcctgcagctgatcaacgtgacccagcacagcatcagaatcaccgacacccccggccccaagatcaccagcctgaagaccatcaactgcatcaacctgaaggccctggtgttcaaggagcacagagagatcgagatcaacgtgctgctgccccaggtggccgtgaacctgagcaactgccacgtgctgatcaagagccacgcctgcgactacagcctggacatcgacggccccgtgagactgcccagaatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatgggcttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagccacggcgagaccgtggaggtgtaccagaccagagagggctacaccagcatctgcctgttcgtgctgggcagcatcctgttcctggtgagctgcctgatgaagggcctggtggacagcgtgggcaacagcttcagccccggcctgagcatctgcaagacctgcagcatcggcagcatcaacggcttcgagatcgagagccacaagtgctactgcagcctgttctgctgcccctactgcagacactgcagcgccgacatcgagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccggcaaggccggctgctggctggagagcatcaagagcttcttctacggcctgaagaacatgctgagcggcatcttcggcaacgtgttcatcggcatcttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaagaacaagaagggcaagaacaagctgctggacggcgagagactggccgacagaaagatcgccgagctgttcagcaccaagacccacatcggctga

SEQ ID NO: 8735 - RNA, 5055 nt, synthetic construct
  misc_feature 1..5055: note = derived and/or modified CDS sequence (opt4) from CCHFV(66019)__AB069669.1__GP
  source 1..5055: mol_type = other RNA
atgtacaccctgctggtgtgcgccgtgctgtgcccccagctgtggagcctggagggcacccacgtgccccacaacgagaccaagcacaacggcaccggcatcaccgccgcccccggcgagagccagggccccatgagccccgccagcaccgccgtgcccctgacccccgagccccccaacaccaagcccgccgccagcgccagcgagctggagagcagcggcgagggccacaccagcctgctggccaccacccagggcctgaccagccccgaggccacccccgagctgcccaccaccaccgacaccggcgtgagcagcaccagcgtggtggacatcggcacccagatggccaaggacacccccaccagcaccgcccacaccagcctgcccagcaaccccagcgcccccagcaccgcccagggcacccaccacaccatcagaggcctgctgagcgtgaccagcaccaagcccgaggaggccagcacccccaccgaccccggcaaggccggcgccgagaccggcagccccagacccgccatcagcagaaagcccaccctgagccccaccgccgaggcccccaccgagatcaacaacagcagcacccccaagcagcccgagcccagcatccagcccgccacccccagcctggtgatcagccccgcccagcccgccttcccccagagcgccaccagcaccgccgcccaggacatctacagcagccccaccaacagaagcaagagaaacctgaagatggagatcatcctgaccctgagccagggcctgaagaagtactacggcaagatccagaagaccctgggcctgaccctggaggaggacaccgagggcctgctggagtggtgcaagagaaacctgggcctgacctgcgacgacaacttcttccagaagagaatcgaggagttcttcctgaccggcgagggctacttcaacgaggtgctgcagttcaagacccccagcacccccggcagcaccgagcccacccacaccgaggcccccaccgtgaagcccttcaagagctacttcgccagaggcttcctgaccatcgacagcggctacttcagcgccaagtgctacagcagaaccagcaacagcggcctgcagctgatcaacgtgacccagcaccccgccagaatcgccgacacccccggccccaagatcaccaacctgaagaccatcaactgcatcaacctgaaggccagcgtgttcaaggagcacagagagatcgagatcaacgtgctgctgccccaggtggccgtgaacctgagcaactgccacgtgctgatcaagagccacgtgtgcgactacagcctggacatcgacggcaccatcagactgcccagaatctaccacgagggcaccttcatccccggcacctacaagatcgtgatcgacaagagagacaagcagaacgacagatgcaccctggtgaccaactgcgtgatcaagggcagagaggtgagaagaggccagagcgccctgagacagtacagaaccgagatcagaatcggcaaggccagcgccggcagcagaagactgctgagcgaggagagcggcgacgactgcatcagcagaacccagctgctgagaaccgagaccgccgaggtgcacggcgacaactacggcggccccggcgacaagatcaccatctgcaacggcagcaccatcgtggaccagagactgggcagcgagctgggctgctacaccatcaacagagtgaagagcttcaagctgtgcgagaacagcggcaccggcaagagctgcaagatcgacaacacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcttctgcaagatcatcttctacctgctgatcgtggtgggcaccctgggcaagaagttcaagcagtacagagagctgaagccccagacctgcaccatctgcgagaccacccccaccaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgaggcctaccagaccagagagggctacaccagcgtgtgcctgttcatgctgggcggcatcctgttcgtggtgagctgcctgatgaagggcctggtggacagcgtgagcaacagcttcttccccggcctgagcatctgcaagacctgcagcatcggcagcgtgaacggcttcgagatcgagagccacaagtgctactgcagcctgctgtgctgcctgtactgcagacactgcagcgccgacagagagatccaccagctgcacctgagcatctgcaagaagagaagagccggcggcaacgtgatgctggccgtgtgcaagagaatgtgcctgagagccaccatggaggtgagcaacaaggtgctgttcatcagaagcatcatcaacaccaccttcgtgatctgcatcctggtgctggccgtgtgcatcgtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcaactgccccgacagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaacagccaggagagacagtgcagcctgatcgaggccggcaccagattcaacctgggccccgtgaccatcaccctgagcgagcccagaaacatccagcagaagctgcccagcgagatcatcaccctgcaccccagaatcgaggagggcttcttcgacctgatgcacgtgcagaaggtgctgagcgccagcaccgtgtgcaagctgcagagctgcacccacggcgtgcccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgccatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagatacctgaaggacgacgaggagagcggctacagaagaatcatcgagagactgaacaacaagaagggcaagaacaagctgctggacggcgagagactggccgacagaagaatcgccgagctgttcagcaccaagacccacatcggctga

SEQ ID NO: 8736 - RNA, 5052 nt, synthetic construct
  misc_feature 1..5052: note = derived and/or modified CDS sequence (opt4) from CCHFV(Gaib)__KX013445.1__GP
  source 1..5052: mol_type = other RNA
atgtacatccccctggtgtacgccgtgatctacctgcagctgtacggcctgggcggcgcccacggcctgctgaacaagaccgagcagaacgagaccggcatcaccgccacccacggcagagtgcagggcccccccagcgccagcatcaccctgcccgtgacccccgaccccctgagcgccaccagcgccgccagcaccagcggccccgagggcagcggcgaggtgcccaccagccccagcaccatcacccagggcctgaccagcagcgagaacaccccccagctgcccaccgccaccgacaccggcatcagcagcaccagcatcatcgacgtgagcacccagaccgccggcgacaccagcacccccaccgcccacaccagcctgcccaacagccccagcgcccccttcaccagccaggacaccagacacaccgtgagaggcctgctgaccgtgaccagcaccaagagcgacgaggccagcaccctgaccgaccccaaggaggccagcaccgaggccagaagccccagccccagcatcagcagaacccccacccccagccccaccgtgcaggccagcaccgagaacaacacccccagcacccccagacagcccgagcccaccaccagacccgccctgcccagccccaccaccagccccacccagcccagcctgagccagagcgccaccagcgccgccatccaggacatgcaccccagccccaccaacagaagcagaagaaacctggagatggagatcatcctgaccctgagccagggcctgaagaagtactacggcaagatcctgaagctgctggacctgaccctggaggaggacaccgagggcctgctggagtggtgcaagagaaacctggacctgacctgcgacgagaacttcttcctgaagagaatcgaggagttcttcctgagcggcgagggccacttcaacgaggtgctgcagttcaaggcccccagcaccatgagcagcaccgagcccacccacgccggcccccccaccgtggagcccttcaagagctacttcgccaagggcttcctgagcatcgacagcggctacttcagcgccaagtgctaccccagaaccagcaacagcggcctgcagctgatcaacgtgacccagcacaccgccagaatcgccgacacccccggccccaagatcaccaacgtgaagaccatcaactgcatcaacctgaaggccagcgtgttcaagaagcacagagaggtggagatcaacgtgctgctgccccagatcgccgtgaacctgagcaactgccacgtgctgatcaagagccacgtgtgcgactacagcctgaacttcgacggcatggtgagactgcccagaatccaccacgagggcaccttcatccccggcacctacaagatcgtgatcgacagaaagaacaagcagaacgacagatgcaccctggtgaccaactgcgtgatcaagggcagagaggtgagaaagggccagagcgccctgagacagtacagaaccgagatcaagatcggcgaggccagcatcggcagcagaagactgctgagcgaggagagcagcgacgactgcatcagcagaacccagctgctgagaaccgagaccgccgagatccacaacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcatccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcttctgcaaggccatcttctacctgctgatcatcgtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtggtgcactgccccaagagaaaggagaagatcgaggagaccgagctgtacctgaacctggagagagtgccctgggtggtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacaccagcatctgcctgttcgtgctgggcggcatcctgttcatcgtgagctgcctgatgaagggcctggtggacagcgtgggcaacaacttcttccccggcctgaccatctgcaagacctgcagcatcagcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcctgagagtgaccaccgaggtgagcaacagagccctgttcatcagaagcatcatcaacaccaccttcgtgatctgcatcctgatcctggccgtgtgcgtgatcagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcatcgagcacagaggcaacaagatcctggtgagcggcagaagcgagagcatcatgaagctggaggagagaaccggcatcagctgggacctgggcgtggaggacgccagcgagagcagactgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcagagaggacacccagaagtgcgtgagcaccaagctggagcagccccagagcatcctgatcgagcacaagggcaccatcatcggcaagcagaacaacacctgcaccaccaagaccacctgctggctggagagcgtgaagagcttcttctacggcctgaagaacatgctgagcagcatcttcggcaacgtgttcgtgggcatcttcagcttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagagcaagctgctggacggcgagagactggccgacagaaagatcgccgagctgttcagcaccaagacccacatcggctga

SEQ ID NO: 8737 - RNA, 5055 nt, synthetic construct
  misc_feature 1..5055: note = derived and/or modified CDS sequence (opt4) from CCHFV(SPU415/85)__DQ211635.1__GP
  source 1..5055: mol_type = other RNA
atgtacacccccctggtgtgcgccgtgatctgcctgcagctgtggaacctgggcggcaccctggtgttcatcaacagaacccagcacaacgagaccggcaccgtggccacccccgagggcaccctgagacccagactgcccgtgagcaccgccctgcccaccaagagcgacagacccagcgtgggccccgccgccagcagcagcggcctggagggcagcggcgagcccaacaccagccccagcatcaccaccaagggcctgaccccccccgagaccacccccgccctgcccaccgccaccgacaccgacgccagcagcaccggcgtggtggacgtgagcacccagatgaccaaggacatccccatgagcaccgcctacaccaacccccccagcacccccagcgcccccagcaccccccagggcacccaccacaccgccagaggcctgctgagcgtggccagcaccaagagcgaggaggtgagcatgagcaccagccccgccaagaccagcaccgagaccagcagccccccccccgccaccagcgagacccccacccccagccccaccacccaggtgcccaccggcaacaacaaccccaacaccagcagacagcccacccccagcgcccagcccgccatgagcaaccccgccaccagccccgcccagcccaacctgagccagagcgccccccccaccgccgaccagggcgtgcaccccagccccaccaacagaagcaagagaaacctggagatcgagatcatcctgaccctgagccagggcctgagaaagtactacggcaagatcctgaagctgctggacctgaccctggaggaggacaccgagggcctgctggagtggtgcaagagaaacctgggcctgacctgcgacgacaacttcttccagaagagaatcgaggagttcttcctgaccggcgagggctacttcaacgaggtgctgcagttcaaggtgcccagcaccctgagcagcaccgagcccacccacaccagaccccccaccgtggagcccttcaagagctacttcgccaagggcttcctgagcatgaacagcggctacttcagcgccaagtgctaccccagaaccagcaacagcggcctgcagctgatcaacgtgaccaagcacagcgccaagatcgccgacacccccggccccaagatcaccaacctgaagaccatcaactgcatcaacctgagagccagcgtgttcaaggagcacagagaggtggagatcaacgtgctgctgccccaggtggccgtgaacctgagcaactgccacgcccagatcaagagccacgtgtgcgactacagcctggccaccgacggcatggtgagactgccccacatccaccacgagggcaccttcatccccggcacctacaagatcgtgatcgacaagaagaacaagcagaacgacagatgcaccctggtgaccaactgcgtgatcaagggcagagaggtgagaaagggccagagcgccctgagacagtacaagaccgagatcagaatcggcaaggccagcagcggcagcagaagactgctgagcgaggagagcgacggcgactgcatcagcagaacccagctgctgagaaccgagaccaccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcaactgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccatccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggccacggcaagaccatcgagacctaccaggccagagagggctacaccagcttctgcctgttcatcctgggcagcatcctgttcgtggtgagctgcctggtgaagggcctgatcgacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccatcgaggtgagcaacagagccctgctgatcagaaacatcatcaacaccaccttcgtggtgtgcatcctgaccctggccgtgtgcgtggtgagcaccagcgccgtggagatggagagcctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagagagtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgaagatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacaccagaaagtgcgtgaacaccaagctggacagaccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggctga

SEQ ID NO: 8738 - RNA, 5055 nt, synthetic construct
  misc_feature 1..5055: note = derived and/or modified CDS sequence (opt4) from CCHFV(SPU 431/85)__KJ682812.1__GP
  source 1..5055: mol_type = other RNA
atgtacacccccctggtgtgcgccgtgatctgcctgcagctgtggaacctgggcggcaccctggtgagcaccaacagaacccagcacaacgagaccggcaccgtggccacccccgagggcaccctgagacccagactgcccgtgagcaccgccctgcccaccaagagcgacagacccagcgtgggccccgccgccagcagcagcggcctggagggcagcggcgagcccaacaccagccccagcatcaccaccaagggcctgaccccccccgagaccacccccgccctgcccaccgccaccgacaccgacgccagcagcaccggcgtggtggacgtgagcacccagatgaccaaggacatccccatgagcaccgcctacaccaacccccccagcacccccagcgcccccagcaccccccagggcacccaccacaccgccagaggcctgctgagcgtggccagcaccaagagcgaggaggtgagcatgagcaccagccccgccaagaccagcaccgagaccagcagccccccccccgccaccagcgagacccccacccccagccccaccacccaggtgcccaccggcaacaacaaccccaacaccagcagacagcccacccccagcgcccagcccgccatgagcaaccccgccaccagccccgcccagcccaacctgagccagagcgccccccccaccgccgaccagggcgtgcaccccagccccaccaacagaagcaagagaaacctggagatcgagatcatcctgaccctgagccagggcctgagaaagtactacggcaagatcctgaagctgctggacctgaccctggaggaggacaccgagggcctgctggagtggtgcaagagaaacctgggcctgacctgcgacgacaacttcttccagaagagaatcgaggagttcttcctgaccggcgagggctacttcaacgaggtgctgcagttcaaggtgcccagcaccctgagcagcaccgagcccacccacaccagaccccccaccgtggagcccttcaagagctacttcgccaagggcttcctgagcatgaacagcggctacttcagcgccaagtgctaccccagaaccagcaacagcggcctgcagctgatcaacgtgaccaagcacagcgccaagatcgccgacacccccggccccaagatcaccaacctgaagaccatcaactgcatcaacctgagagccagcgtgttcaaggagcacagagaggtggagatcaacgtgctgctgccccaggtggccgtgaacctgagcaactgccacgcccagatcaagagccacgtgtgcgactacagcctggccaccgacggcatggtgagactgccccacatccaccacgagggcaccttcatccccggcacctacaagatcgtgatcgacaagaagaacaagcagaacgacagatgcaccctggtgaccaactgcgtgatcaagggcagagaggtgagaaagggccagagcgccctgagacagtacaagaccgagatcagaatcggcaaggccagcagcggcagcagaagactgctgagcgaggagagcgacggcgactgcatcagcagaacccagctgctgagaaccgagaccaccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcaactgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccatccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggccacggcaagaccatcgagacctaccaggccagagagggctacaccagcttctgcctgttcatcctgggcagcatcctgttcgtggtgagctgcctggtgaagggcctgatcgacagcgtgggcaacagcttcttccccggcctgagcatctgcaagacctgcagcatcggcagcatcaacggcttcgagatcgagagccacaagtgctactgcagcctgttctgctgcccctactgcagacactgccccgccgacagagagatccacaagctgcacctgagcatctgcaagaagagaaagaccggcagcaacgtgatgctggccgtgtgcaagagaatgtgcttcagagccaccatcgaggtgagcaacagagccctgctgatcagaaacatcatcaacaccaccttcgtggtgtgcatcctgaccctggccgtgtgcgtggtgagcaccagcgccgtggagatggagagcctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcagaaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagagagtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgaagatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacaccagaaagtgcgtgaacaccaagctggacagaccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggctga

SEQ ID NO: 8739 - RNA, 5055 nt, synthetic construct
  misc_feature 1..5055: note = derived and/or modified CDS sequence (opt4) from CCHFV(8402)__AB069674.1__GP
  source 1..5055: mol_type = other RNA
atgtacacccccctgctgtgcgccgtgctgtgcctgcagctgtggagcctggagggcagccacggcctgagcaacaagacccagcacagcaacaccagcaccaccaaggcccccgaggtgagccaggagctgggcctgcccgtgagcaccgtgagcaccatcaccagcgacccccccagcatcaccagcgccgtgagcgtgagcggcagcgagggcagcggcgacaccaacaccagccccagcgtgaccacccagggccccaccctgcccgagaccaccctggagcccctgaccaccaccgacaccgacgccagcagcaccgtggtggtggacgtgagcacccagaccgtgaaggacacccccatcagcaccacctacaccagcctgcccagcacccccagcgagcccaccaccccccagggcacccaccacaccgccagaggcctgctgagcgtgaccagcaccaagcccgaggaggccagcacccaggccaaccccggcaagatcagcatggagaccaacggccccagactggccatcagcgagacccccagcttcagccccaccacccaggcccccaccgagaacagcaaccccatcaccagcaagcagctgatgctgagcgcccagcccgtgacccccaaccccatgaccagccccgtgcagcccgccctgagccagagcgacaccagcaccgccatccaggacgtgcaccccagccccaccggcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacaacttcttccagaagagaatcgaggagttcttcctgaccggcaagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaagatcaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgctgagaaccgagaccgccgagatccacaacgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacagactgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagagcaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8740 - RNA, 5055 nt, synthetic construct
  misc_feature 1..5055: note = derived and/or modified CDS sequence (opt4) from CCHFV(SPU 383/87)__KJ682806.1__GP
  source 1..5055: mol_type = other RNA
atgtacacccccctgctgtgcgccatcctgtgcctgcagctgtggagcctggagggcatctacggcctgagcaacagaacccagcacaacgacaccagcaccatcaaggtgcccgaggagagccagaagaccagcctgcccgccaacaccgccagccccatcaccagcgacccccccagcaccaccagcaccgccagcgccagcggccccgagggcagcggcgacaccagcaccagcccccccgtgaccacccagggccccaccccccccgagaccacccccgagccccacaccaccatcgacatcgacaagagcagcaccgccatcgccgacatcagcacccagaccgtgaaggacatccccacccccaccacccacaccagcctgcccagcaccctgagcgcccccaccatcccccaggaggcccaccacaccgccagaggcctgctgagcatcaccagcaccaagcccggcgaggccagcacccccatcagccccggcgaggccagcaccgaggccagcagcccccagcccaccatcagcgagacccccagccccccccccaccgcccaggcccccaccgagatcaacagccccaacaccagcagacagcccatgcccagcacccagcccgccgcccccaacagcgtgacccaccccgcccagcccacccccagccagagcgacgtgcccaccgccgcccaggacatccaccccaaccccatcaacagaagcaagagaaacctggagatggagatcatcctgaccctgagccagggcctgaagaagtactacggcaaggtgctgaagctgctggacctgaccctggaggaggacaccgagggcctgctggagagctgcaagagaaacctgggcctgacctgcgacgacaacttcttccagaagagaatcgaggagttcttcctgaccggcgagggccacttcaacgaggtgctgcagttcaagacccccagcaccctgagccccaccgagcccgccagagtggagagccccaccgtggagcccttcaagagctacttcgccaagggcttcctgagcatggacagcggctacttcagcgccaagtgctacagcaagagcagcaacagcggcctgcagctgatcaacgtgacccagcacctgatcagaatcaccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgctgatcaagagccacgtgtgcgactacagcctggacatcgacggccccgtgagactgcccagaatccaccacgagggcaccttcatccccggcacctacaagatcgtgatcgacaagaacaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctggtggtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatccagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagccacggcgagaccgtggaggtgtaccagaccagagagggctacaccagcatctgcctgttcgtgctgggcagcatcctgttcctggtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacatcgagatccacagactgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcttcggcaagcagaacgacacctgcaccgccaaggccagctgctggctggagagcgtgaagagcttcttctacggcctgaagaacatgctgagcggcatcttcggcaacgtgttcatcggcgtgttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggctga

SEQ ID NO: 8741 - RNA, 5055 nt, synthetic construct
  misc_feature 1..5055: note = derived and/or modified CDS sequence (opt4) from CCHFV(SPU 497/88)__KJ682808.1__GP
  source 1..5055: mol_type = other RNA
atgtacacccccctgctgtgcgccatcctgtgcctgcagctgtggagcctggagggcatctacggcctgagcaacaagacccagcacaacgacaccagcaccatcaaggtgcccgaggagagccagaagaccagcctgcccgccaacatcgccagccccaccaccagcgacccccccagcgccaccagcaccgccagcgccagcggccccgagggcagcggcgacaccagcaccagccccagcgtgaccacccagggccccacccccctggagatcacccccgagccccacaccaccatcgacatcgacaagagcagcaccagcatcgccgacatcagcaccagaaccgtgaaggacatccccacccccaccacccacaccagcctgcccagcacccccagcgcccccaccatcccccaggaggtgcaccacaccgccagaggcctgctgagcgtgaccagcaccaagcccgaggaggccagcaccctgaccagccccggcgaggccagcaccgaggccagcagcccccagcccaccatcagcgagacccccagccccccccccaccacccaggcccccaccgagatcaacaaccccaacaccagcagacagcccatgcccagcacccagcccgccgcccccaacagcgtgaccccccccgtgcagcccaccttcagccagagcgacgtgagcaccgccgcccaggacatccaccccagccccaccaacagaagcaagagaaacctggagatggagatcatcctgaccctgagccagggcctgaagaagtactacggcaaggtgctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagccccaccgagcccgccagagtggagagccccaccgtggagcccttcaagagctacttcgccaagggcttcctgagcatggacagcggctacttcagcgccaagtgctaccccaagagcagcaacagcggcctgcagctgatcaacgtgacccagcacctgatcagaatcaccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgctgatcaagagccacgtgtgcgactacagcctggacatcgacggccccgtgagactgcccagaatccaccacgagggcaccttcatccccggcacctacaagatcgtgatcgacaagaagaccaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcaagggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggtgttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagccacggcgagaccgtggaggtgtaccagaccagagagggctacaccagcatctgcctgttcgtgctgggcggcatcctgttcctggtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacatcgagatccacaagctgcacctgagcatctgcaagaagagaaagacctggagcaacgtgatgctggccgtgtgcaagagaatgtgcttcagagccaccgtggaggtgagcaacaaggccctgctgatcagaaacatcatcaacaccaccttcgtggtgtgcatcctgatcctggccatctgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgagaaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccagagccagctgctggctggagagcatcaagagcttcttctacggcctgaagaacatgctgagcggcatcttcggcaacgtgttcatcggcatcttcctgttcttcgcccccttcatcatgctgatcctgttcttcatgttcggctggagaatcctgttctgcttcaagtgctgcagaagaaccagaggcctgttcaagtacagacacctgaaggacgacgaggaggtgggctacagaaagatcatcgagagactgaacaacaagaagggcaagaacaagctgctggacggcgagagactggccgacagaaagatcgccgagctgttcagcaccaagacccacatcggctga

SEQ ID NO: 8742 - RNA, 5055 nt, synthetic construct
  misc_feature 1..5055: note = derived and/or modified CDS sequence (opt4) from CCHFV(88166)__AB069675.1__GP
  source 1..5055: mol_type = other RNA
atgtacacccccctgctgtgcgccgtgctgtgcctgcagctgtggagcctggagggcagccacggcctgagcaacaagacccagcacagcaacaccagcaccaccaaggcccccgaggtgagccaggagctgggcctgcccgtgagcaccgtgagcaccatcaccagcgacccccccagcatcaccagcgccgtgagcgtgagcggcagcgagggcagcggcgacaccaacaccagccccagcgtgaccacccagggccccaccctgcccgagaccaccctggagcccctgaccaccaccgacaccgacgccagcagcaccgtggtggtggacgtgagcacccagaccgtgaaggacacccccatcagcaccacctacaccagcctgcccagcacccccagcgagcccaccaccccccagggcacccaccacaccgccagaggcctgctgagcgtgaccagcaccaagcccgaggaggccagcacccaggccaaccccggcaagatcagcatggagaccaacagccccagactggccatcagcgagacccccagcttcagccccaccacccaggcccccaccgagaacagcaaccccatcaccagcaagcagctgatgctgagcgcccagcccgtgacccccaaccccatgaccagccccgtgcagcccgccctgagccagagcgacaccagcaccgccatccaggacatccaccccagccccaccggcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacaacttcttccagaagagaatcgaggagttcttcctgaccggcaagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaagatcaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgctgagaaccgagaccgccgagatccacagcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatgggcttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacagactgcacctgagcatctgcaagaagagaaagacctggagcaacgtgatgctggccgtgtgcaagagaatgtgcttcagagccaccgtggaggtgagcaacaaggccctgctgatcagaaacatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctggaacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacctggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8743 - RNA, 5055 nt, synthetic construct
  misc_feature 1..5055: note = derived and/or modified CDS sequence (opt4) from CCHFV(strain BA88166)__AF338470.1__GP
  source 1..5055: mol_type = other RNA
atgtacacccccctgctgtgcgccgtgctgtgcctgcagctgtggagcctggagggcagccacggcctgagcaacaagacccagcacagcaacaccagcaccaccaaggcccccgaggtgagccaggagctgggcctgcccgtgagcaccgtgagcaccatcaccagcgacccccccagcatcaccagcgccgtgagcgtgagcggcagcgagggcagcggcgacaccaacaccagccccagcgtgaccacccagggccccaccctgcccgagaccaccctggagcccctgaccaccaccgacaccgacgccagcagcaccgtggtggtggacgtgagcacccagaccgtgaaggacacccccatcagcaccacctacaccagcctgcccagcacccccagcgagcccaccaccccccagggcacccaccacaccgccagaggcctgctgagcgtgaccagcaccaagcccgaggaggccagcacccaggccaaccccggcaagatcagcatggagaccaacagccccagactggccatcagcgagacccccagcttcagccccaccacccaggcccccaccgagaacagcaaccccatcaccagcaagcagctgatgctgagcgcccagcccgtgacccccaaccccatgaccagccccgtgcagcccgccctgagccagagcgacaccagcaccgccatccaggacatccaccccagccccaccggcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacaacttcttccagaagagaatcgaggagttcttcctgaccggcaagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaagatcaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgctgagaaccgagaccgccgagatccacagcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatgggcttcctgttctggttcagcttcggctacgtggtgacctgcatcctgtgcaagggcatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacagactgcacctgagcatctgcaagaagagaaagacctggagcaacgtgatgctggccgtgtgcaagagaatgtgcttcagagccaccgtggaggtgagcaacaaggccctgctgatcagaaacatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgtacctggacagcatcgtgaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctggaacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgatcatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8744 - RNA, 5055 nt, synthetic construct
  misc_feature 1..5055: note = derived and/or modified CDS sequence (opt4) from CCHFV(SPU 130/89)__KJ682807.1__GP
  source 1..5055: mol_type = other RNA
atgtacacccccctgctgtgcgccatcctgtgcctgcagctgtggagcctggagggcatctacggcctgagcaacaagacccagcacaacgacaacagcaccaccaaggcccccgaggagagccacaagaccagcctgcccgccaacaccgccagccccatcaccagcgacccccccagcaccaccagcaccaccagcgccagcggccccgagggcagcggcgacaccagcaccagcccccccgtgaccacccagggccccgccagccccgagaccacccccgagccccacaccaccatcgacatcgacaagagcagcaccgccatcgccgacatcagcacccagaccgtgaaggacatccccacccccaccacccacaccagcctgcccagcaccctgagcgcccccaccatcccccaggaggcccaccacaccgccagaggcctgctgagcgtgaccagacacaagcccggcgaggccagcaagcccaccagccccggcgaggccagcaccgaggccagcagcagccagcccaccatcagcgagacccccagccccccccccaccacccaggcccccaccgagatcaacaaccccaacaccagcagacagcccatgcccagcacccagcccgccgcccccagcagcgtgacccaccccgcccagcccacccccagccagagcgacgtgcccaccgccgcccaggacatccaccccagccccaccaacagaagcaagagaaacctggagatggagatcatcctgaccctgagccagggcctgaagaagtactacggcaaggtgctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagccccaccgagcccgccagagtggagagccccaccgtggagcccttcaagagctacttcgccaagggcttcctgagcatggacagcggctacttcagcgccaagtgctaccccaagagcagcaacagcggcctgcagctgatcaacgtgacccagcacctgatcagaatcaccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgctgatcaagagccacgtgtgcgactacagcctggacatcgacggccccgtgagactgcccagcatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagcccaactacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcagccacggcgagaccgtggaggtgtaccagaccagagagggctacaccagcatctgcctgttcgtgctgggcagcatcctgttcctggtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacatcgagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgagcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagcactgcaagagctgcagcaaggaggacacccagagatgcgtgaacaccaagctggagcagccccagagcatcctgatcgagcacaagggcaccatcatcggcaagcagaacgacacctgcaccgccaaggccagctgctggctggagagcatcaagagcttcttctacggcctgaagaacatgctgagcggcatcttcggcaacgtgttcatcggcgtgttcctgttcctggcccccttcatcatcctgatcctgttcttcatgttcggctggagaatcctgttctgcttcaagtgctgcagaagaaccagaggcctgctgaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggctga

SEQ ID NO: 8745 - RNA, 5052 nt, synthetic construct
  misc_feature 1..5052: note = derived and/or modified CDS sequence (opt4) from CCHFV(4701-ST-2009)__KR814872.1__GP
  source 1..5052: mol_type = other RNA
atgcacaccctgctggtgtgcttcatcctgtacctgcagctgagcggcctgggcggcgcccacggccagagcaacgccaccgagcacaacggcaccaacaccaccaccgcccccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccctgaccggcaccacccccgagagaagcgccaccaccgccaccagcaccagcagcaccgacaacatgaacagcaccacccaggtgaccgacaacacccccaccagcaccgtgagcatcagccccagcagcagcagcagcatgcccagcaccccccagggcacccaccaccccgtgagaagcctgctgagcgtgagcagccccaagaccgtgaccacccccacccccatgagccccggcgagatgagccccgagaccagcagccagcacagcgccatgagcagagtgcccaccctgtacaccgccacccaggtgagcaccgagaacaccgacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacagaaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcggcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8746 - RNA, 5052 nt, synthetic construct
  misc_feature 1..5052: note = derived and/or modified CDS sequence (opt4) from CCHFV(36-ST-2014)__KR814857.1__GP
  source 1..5052: mol_type = other RNA
atgcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccccccccggcaccacccccgagagacccgccaccaccgccaccagcatgagcagcaccgacaacatgaacagcaccacccaggtgaccgacaacacccccaccagcaccgtgagcatcagccccagcagcagccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccacccaggtgagcaccgagaacaccaacagaagcacccccagacagagcgagagcagcgcccagcccgccacccagagccccaccaccagccccacccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgagcgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggaccagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgtgcggctggaagttcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagagccacatcggctga

SEQ ID NO: 8747 - RNA, 5055 nt, synthetic construct
  misc_feature 1..5055: note = derived and/or modified CDS sequence (opt4) from CCHFV(Matin)__AF467769.2__GP
  source 1..5055: mol_type = other RNA
atgtacaccctgctgctgtgcgccatcctgtgcagccagctgtggagcagcgagggcatccacggcctgagcaacgagacccagcacggcaacgccagcaccatcaaggcccccgaggtgagccagggcctgggcctgcccgtgagcaccgccccccccatcaccagcgacccccccagcatcaccagcgccgccagcgtgagcggccccgagggcagcggcgacaccaacaccagcccccccgtgaccacccagggcctgaccctgcccgagaccaccctggagctgctgaccaccaccaacaccggcgccagcagcaccgtgatcgtggacgtgagcacccagaccgtgaaggacacccccgtgagcaccgcccacaccagcccccccggcacccccagcgcccccaccaccccccagggcacccaccacaccgccagaggcctgctgagcgtgaccagcaccaagagcgaggaggccagcacccagaccaaccccaagaagaccagcatggagaccaacagccccggccccgccaccagcgagacccccagccccagccccaccacccaggcccccaccgagaacaacaaccccaacacccccagacagcccaccccccccacccagcccgccacccccagccccgtgaccagccccgccctgctggccagcagccagggcgacaccagcaccgccgtgcaggacgtgcaccccagccccaccaacagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacagcttcttccagaagagaatcgaggagttcttcctgaccggcgagggccacttcaacgaggtgctgcagttcaagacccccagcaccctgagccccaccgagcccgccagagccggcagccccaccgtggagcccttcaagagctacttcgccagaggcctgctgagcatggacagcggctacttcagcgccaagtgctaccccagagccagcaacagcggcctgcagctgatcaacatcacccagcacagcgccagaatcaccgacacccccggccccaagatcaccaacctgaagaccatcaactgcatcaacctgaaggccagcaccttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagatcgtgatcgacaagaagaacaagcagaacgacagatgcaccatcgtgaccaactgcgtgatcaagggcagagagatcagaaagggccagagcgtgctgagacagtacaagaccgagatcaagatcggcaaggccagcagcggcagcagaagactgctgagcgaggagagcggcgacgactgcatcagcagaacccagctgctgagaaccgagaccgccgagatccacagcgacagctacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggtgttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagatcagagagggctacaccagcgtgtgcctgttcgtgctgggcagcatcctgttcatcgtgagctgcctgatgaagggcctggtggacagcgacggcaacagcttcttccccggcctgagcatctgcaagacctgcagcatcggcagcatcaacggcttcgagatcgagagccacaagtgctactgcagcctgttctgctgcccctactgcagacactgcagcaccgacagagagatccacaagctgcacctgagcatctgcaagaagagaaagaccggcagcaacgtgatgctggccgtgtgcaagagaatgtgcttcagagccaccgtggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgatcaacttctgccaccaggagtgccaggtgaccgagaccgagtgcctgtgcccctacgaggccctggtgctgagaaagcccctgttcctggacagcatcatcaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggtgatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgagcatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcgccctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacgtgggctga

SEQ ID NO: 8748 - RNA, 5052 nt, synthetic construct
  misc_feature 1..5052: note = derived and/or modified CDS sequence (opt4) from CCHFV(UCCR4405)__KY484029.1__GP
  source 1..5052: mol_type = other RNA
atgcacgccctgctggtgtgcttcatcctgtacctgcagctgagcggcctgggcggcgcccacagacagagcaacgccaccgagcacaacggcaccaacaccaccaccgcccccggcaccagccagagccccaagccccccgtgagcaccaccctgccccacacccccgaggccagcaccatcaagctgaccacccccaccagcgagaccgagggcagcggcgagaccacccccccccccaacaccacccagggcctgcccctgcccggcaccacccccgagagaagcgccaccaccgccaccagcaccagcagcaccgacgacatgaacagcaccacccagatgaccgacaacacccccaccagcaccgtgagcatcggcctgagcagcagccccagcatgcccagcaccagccagggcatccactaccccgtgagaagcctgctgagcgtgagcagccccaagaccgccaccacccccacccccatgagccccggcgaggtgagccccgagaccagcagccagcacagcgccatgagcagaatccccaccctgtacaccgccacccaggtgagcaccgagaacaccaacagaagcatccccagacagagcgagagcagcgtgcagcccgccacccagagccccatcaccagccccgcccagaccatcctgctgatgagcgccgcccccaccgccatccaggacatgcaccccagccccaagaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagacccccagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcgccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactacagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgatcctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcaactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggtgtgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcatcttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8749 - RNA, 5052 nt, synthetic construct
  misc_feature 1..5052: note = derived and/or modified CDS sequence (opt4) from CCHFV(Drosdov)__DQ211630.1__GP
  source 1..5052: mol_type = other RNA
atgcacgccctgctggtgtgcttcatcctgtacctgcagctgagcggcctgggcggcgcccacagacagagcaacgccaccgagcacaacggcaccaacaccaccaccgcccccggcaccagccagagccccaagccccccgtgagcaccaccctgccccacacccccgaggccagcaccatcaagctgaccacccccaccagcgagaccgagggcagcggcgagaccacccccccccccaacaccacccagggcctgcccctgcccggcaccacccccgagagaagcgccaccaccgccaccagcaccagcagcaccgacgacatgaacagcaccacccagatgaccgacaacacccccaccagcaccgtgagcatcggcctgagcagcagccccagcatgcccagcaccagccagggcatccactaccccgtgagaagcctgctgagcgtgagcagccccaagaccgccaccacccccacccccatgagccccggcgaggtgagccccgagaccagcagccagcacagcgccatgagcagaatccccaccctgtacaccgccacccaggtgagcaccgagaacaccaacagaagcatccccagacagagcgagagcagcgtgcagcccgccacccagagccccatcaccagccccgcccagaccatcctgctgatgagcgccgcccccaccgccatccaggacatgcaccccagccccaagaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagacccccagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcgccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactacagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgatcctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatgaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcaactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggtgtgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcatcttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8750 - RNA, 5052 nt, synthetic construct
  misc_feature 1..5052: note = derived and/or modified CDS sequence (opt4) from CCHFV(44-ST-2010)__KR814859.1__GP
  source 1..5052: mol_type = other RNA
atgcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccccccccggcaccacccccgagagacccgccaccaccgccaccagcatgagcagcaccgacaacatgaacagcaccacccaggtgaccgacaacacccccaccagcaccgtgagcatcagccccagcagcagccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccacccaggtgagcaccgagaacaccaacagaagcacccccagacagagcgagagcagcgcccagcccgccacccagagccccaccaccagccccacccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgctgtggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcttcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgagcgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggaccagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgtgcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagagccacatcggctga

SEQ ID NO: 8751 - RNA, 5052 nt, synthetic construct
  misc_feature 1..5052: note = derived and/or modified CDS sequence (opt4) from CCHFV(3756-ST-2007)__KR814866.1__GP
  source 1..5052: mol_type = other RNA
atgcacaccctgctggtgtgcttcatcctgtacctgcagctgagcggcctgggcggcgcccacggccagagcaacgccaccgagcacaacagaaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccctgcccggcaccacccccgagagaagcgccaccaccgccaccagcaccagcagcaccgacaacatgaacaccaccacccaggtgaccgacaacacccccaccagcaccgtgagcatcagccccagcagcagccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccacccaggtgagcaccgagaacatcaacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacagaaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctgacccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8752 - RNA, 5052 nt, synthetic construct
  misc_feature 1..5052: note = derived and/or modified CDS sequence (opt4) from CCHFV(47-ST-2013)__KR814861.1__GP
  source 1..5052: mol_type = other RNA
atgcacaccctgctggcctgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccccccccggcaccacccccgagagaagcgccaccaccgccaccagcaccagcagcaccgacaacatgaacagcaccacccagatgaccggcaacacccccacccccaccgtgaacatgagccccagcagcagccccagcatgcccagcaccagccagggcatccactaccccgtgagaagcctgctgagcgtgcccagccccaagaccgccaccacccccacccccgtgagccccggcgagatgagccccgagaccagcagccagcacagcgccaccagcagaatccccaccctgtacaccgccacccaggtgagcaccgagaacaccaacagaagcacccccagacagagcaagagcagcgtgcagcccgccacccagagccccatcaccccccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctactacgccaagggcttcctgagcctggacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactaccccctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcagaacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgttcatcagaagcatcatcaacaccaccttcgtgacctgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgagtgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8753 - RNA, 5052 nt, synthetic construct
  misc_feature 1..5052: note = derived and/or modified CDS sequence (opt4) from CCHFV(1-CR/HU-2015)__KU161584.1__GP
  source 1..5052: mol_type = other RNA
atgcacaccctgctggtgtgcttcatcctgtacctgcagctgctgggcctgggcggcgcccacgagcagagcaacgccaccgaccacaacagaaccaacaccatcaccgcccccagcaccagccagaaccccaagccccccgccagcaccacccccccccacacccccgagagcagcaccatcaagctgatcaccagcaccggcgaggccgagggcagcggcgagaccaccccccccctgaacaccacccagggccccttcccccccgagaccaccagcgagcaccccgccagcaccgccaccaacaccagcagcaccaacagcatgaacagcaccacccagatgaccgacaacaccctgaccagcaccgtgagcaccagcctgagcatcagccccagcacccccagcaccagccagggcatccactaccccgtgagaagcctgctgagcgtgagcagccccaagaccgccgccacccccacccccatgagcaccagagagatgagcagcgagaccagcagccagcacagcgccatgagcagaacccccaccttccacaccgccacccaggtgagcaccgagaacgccaacagaagcacccccagacagagcgagagcagcgcccagcccgccacccagagccccatgaccagccccgcccagagcatcttcctggtgagcgccgcccccaccaccatccagaacatccaccccagccccaccaacagaagcaagagaaacctggagatggagatcatcctgaccctgccccagggcctgaagaagtactacggcaagatcctgaagctgctgcacctgaccctggaggaggacaccgagggcctgctggagtggtgcaagagaaacctgggcagcaactgcgacgacgagttcttccagaagagaatcgaggagttcttcatcaccggcgagggctacttcaacgaggtgctgcagttcaagaccctgagcaccctgagccccaccgagcccagccacgccagaccccccaccgccgagcccttcaagagctacttcgccaagggcttcctgagcatcgacagcggctacttcagcgccaagtgctaccccagaagcagcaccagcggcctgcagctgatcaacatcacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcagaacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8754 - RNA, 5049 nt, synthetic construct
  misc_feature 1..5049: note = derived and/or modified CDS sequence (opt4) from CCHFV(3820-ST-2007)__KR814868.1__GP
  source 1..5049: mol_type = other RNA
atgcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccaccccccccaacaccacccagggcctgcccctgcccggcaccacccccgagagaagcgccaccaccgccaccagcaccagcagcaccgacaacatgaacagcaccacccaggtgaccgacaacacccccaccagcaccgtgagcatcagccccagcagcagcagcagcatgcccagcaccagccagggcatccaccaccccgtgagaagcctgctgagcgtgagcagccccaagaccgtgaccacccccacccccatgagccccggcgagatgagccccgagaccagcagccagcacagcgccatgagcagagtgcccaccctgtacaccgccacccagatcagcaccgagaacaccgacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacagaaagaacaagctgaacgacagatgcagcctggtgaccaactgcgtgatcaagggcagagaggtgagaaagggccagagcgtgctgagacagtacaagaccgagatcaagatcggcaagaccagcaccggcagcagaaagctgctgagcgaggagcccggcgacgactgcatcagcagaacccagctgctgaagaccgagaccgccgagatccacgacgacaactacggcagccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctggccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8755 - RNA, 5052 nt, synthetic construct
  misc_feature 1..5052: note = derived and/or modified CDS sequence (opt4) from CCHFV(Ast199)__KX056051.1__GP
  source 1..5052: mol_type = other RNA
atgcacaccctgctggtgtgcttcatcctgtacctgcagctgagcggcctgggcggcgcccacgtgcagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccccccccggcaccacccccgagagacccgccaccaccgccaccaccaccagcagcaccgacaacatgaacagcaccacccaggtgaccgacaacacccccaccagcaccgtgagcatcagccccagcagcaaccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccgcccaggtgagcaccgagaacaccaacagaagcacccccagacagagcgagagcagcgcccagcccgccacccagagccccaccaccttccccgcccagaccatccccctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagacccccagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagatgcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggctga

SEQ ID NO: 8756 - RNA, 5052 nt, synthetic construct
  misc_feature 1..5052: note = derived and/or modified CDS sequence (opt4) from CCHFV(Turkey200310849)__DQ211636.1__GP
  source 1..5052: mol_type = other RNA
atgcacaccctgctggtgtgcttcatcctgtacctgcagctgctgtgcctgggcggcgcccacggccagctgaacaccaccgagcacaacggcaccaacaacaccaccgcccccggcgccagccagagccccaagccccccatgagcaccacccccccccacgcccccgagagcagcaccatcaagcccaccacccccatcagcgaggccgagggcagcggcgagaccaccagcacccccaacaccacccagggcctgagcagccccgagaccaccagcgagagacccgccaccaccgccatcagcaccagcagcaccgacagcaccaaccccaccacccagatgaccgacaacacccccaccctgaccgtgagcaccagccccagcagcagccccagcacccccagcaccccccagggcatctaccaccccgccagaagcctgctgagcgtgagcagccccaagaccgtgaccacccccacccccaccagccccggcgagatgagcagcgagaccagcagccagcacagcgccatgagcagaatccccaccccccacaccgccaccagagtgagcaccgagaacaccaaccacagcacccccagacagagcgagagcagcgcccagcagaccacccccagccccatgaccagccccgcccagagcatcctgctgatgagcgccgcccccaccgccgtgcaggacatccaccccagccccaccaacagaagcaagagaaacctggagaccgagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagactgcccaccgccgagcccttcaagagctacttcgccaagggcttcctgagcatcgacagcggctacttcagcgccaagtgctaccccagaagcagcgccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcttcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcagctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagatctaccagaccagagagggcttcgccagcatctgcctgttcatgctgggcagcatcctgttcatcgtgagctgcctggtgaagggcctggtggacagcgtgagcgacagcttcttccccggcctgagcgtgtgcaagacctgcagcatcggcagcgtgaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccgccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggctga

SEQ ID NO: 8757 - RNA, 5052 nt, synthetic construct
  misc_feature 1..5052: note = derived and/or modified CDS sequence (opt4) from CCHFV(5170-R-2011)__KR814873.1__GP
  source 1..5052: mol_type = other RNA
atgcacaccctgctggtgtgcttcatcctgtacctgcagctgagcggcctgggcggcgcccacggccagagcaacgagaccgagcacaacggcaccaacaccaccaccgtgcccggcaccagccagagccccaagccccccgccagcaccaccctgcagcacacccccgagagcagcaccgtgaagctgaccacccccaccagcgagaccgagggcagcggcgagaccacccccccccccaacaccacccagggcctgcccccccccggcaccacccccgagagaagcgccaccaccgccaccagcaccagcagcaccgacaacatgaacagcaccacccaggtgaccgacaacacccccaccagcaccgtgagcatcagccccagcagcagccccagcatgcccagcaccagccagggcatccactaccccatcagaagcctgctgagcgtgagcagccccaagaccgtgaccacccccacccccatcagccccggcgagatgagccccgagaccagcagccagcacagcgccatgagcagaatccccaccctgtacaccgccacccaggtgagcaccgagaacaccaacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagctgagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgagggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8758 - RNA, 5055 nt, synthetic construct
  misc_feature 1..5055: note = derived and/or modified CDS sequence (opt4) from CCHFV(SCT ex Afghanistan)__KC344856.1__GP
  source 1..5055: mol_type = other RNA
atgtacaccctgctggtgtgcgccatcctgtgcccccagccctggagcctggagggcacccacgtgcccctgaacggcaccaagcacaacggcaccggcatcaccgccgcccccggcggcagccagggccccaccagccccgccagcaccgccgtgagcctgacccccgaccccttcaccaccgagcccaccgccagcgccgtggagctggagagcagcggcgagggccacaccagcctgagcgtgaccacccagggcctgaccagccccgagaccacccccggcctgcccaccgtgaccgacaccggcgtgagcagcaccagcatcttcggcatcggcatcagagtggccggcgacacccccaccagcaccacccacaccggcctgcccagcagccccagcatgcccagcaccgcccagggcccccaccacgccgtgagaggcctgctgagcgtgagcagcaccagacccggcgaggccagcaccatcaccgtgcccggcgaggccggcaccgaggccaacagcagcagcagcgccatcagcaagaagcccgcccccagccccaccgccgaggccatcaccgaggccaacaacagcagcaaccccagacagcccgagctgagcacccagcccgccatccccggcctggtgaccagcagcgcccagcccatcctgctgcagagcgccaccagcaccgccgcccaggacatctaccccagccccaccaacagaagcaagagaaacctggagatggagatcatcctgaccctgagccagggcctgaagaagtactacggcaagatcctgagaatcctggacctgaccctggaggaggacaccgagggcctgctggagtggtgcaagagaaacctgggcctgacctgcaacgacaacttcttccaggagagaatcgaggagttcttcctgaccggcgagggccacttcaacgaggtgctgcagttcaagacccccagcaccctgagccccaccgagcccacccacaccagaacccccaccgtgaagcccttcaagagctacttcgccagaggcttcctgagcatcgacagcggctacttcagcgccaagtgctacagcaagaccagcaacagcggcctgcagctgatcaacatcacccagcaccccgccagaatcgccgacacccccggccccaagatcaccaacctgaaggccatcaactgcatcaacctgaaggccagcgtgttcaaggagcacagagagatcgagatcaacgtgctgctgccccaggtggccgtgaacctgagcaactgccacgtgctgatcaagagccacgtgtgcgactacagcctggacatcgacggcgccgtgagactgccccacgtgcaccacaagggcaccttcatccccggcacctacaagatcgtgatcgacaagagaaacaagcagaacgacagatgcaccctggtgaccaactgcgtgatcaagggcaaggagatcagaaagggccagagcgccctgagacagtacagaaccgagatcagaatcggcaaggccagcgccggcagcagaagactgctgagcgaggagagcggcgacgactgcatcagcagaacccagctgctgagaaccgagaccgccgaggtgcacaacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcaagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcttctgcaaggtgatcttctacctgctgatcgtggtgggcaccctgggcaagaagttcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacatcagcgtgtgcctgttcgtgctgggcggcatcctgttcgtggtgagctgcctgatcaagggcctggtggacagcgtgggcaacagcttcttccccggcctgagcatctgcaagacctgcagcatcggcagcgtgaacggcttcgagatcgagagccacaagtgctactgcagcctgctgtgctgcccctactgcagacactgcagcaccgacagagagatccaccagctgcacctgagcatctgcaagaagagaagaaccggcggcaacgtgatgctggccgtgtgcaagagaatgtgcttcagagccaccatggaggtgagcaacaaggtgctgttcatcagaaacatcatcaacaccaccttcgtgatctgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctgaacagcatcgtgaagggcatgaagaacctgctgaacagcaccaacctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagagcctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaagctgaacggccacatgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgacatcagcggcctgaagttcgccagcctgacctgcgccggctgctacgcctgcagcagcggcatcagctgcaaggtgagaatccacgtggacgagcccgacgagctgaccgtgcacgtgaagagcgaggaccccgacatcgtggccgccagcaccagcctgatcgccagaaagctggagctgggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagggcatcctgatcgagcacaagggcaccatcatcggcaagcagaacgacacctgcaccgccaaggccggctgctggctggagagcgtgaagagcttcttctacggcctgaagaacatgctgagcggcatcttcggcaacgtgttcatcggcatcttcctgttcctggcccccttcgtgctgctgatcctgttcttcatgttcggctggagactgctgttctgcttcaagtgctgcagaagaaccagaggcctgttcaagtacagacacctgaaggaggacgaggagagcggctacagaagaatcatcgagagactgaacaacaagaagggcaagaacaagctgctggacggcgagagactggccgacagaagaatcgccgagctgttcagcaccaagacccacatcggctga

SEQ ID NO: 8759 - RNA, 5055 nt, synthetic construct
  misc_feature 1..5055: note = derived and/or modified CDS sequence (opt4) from CCHFV(SPU 44/08)__KJ682805.1__GP
  source 1..5055: mol_type = other RNA
atgtacacccccctgctgtgcgccatcctgtgcctgcagctgtggagcctggagggcatctacggcctgagcaacaacacccagcacaacgacaccagcaccatcaaggtgcccgaggagagccagaagaccagcctgcccgccaacaccgccagccccatcaccagcgaccccccccccaccacccccaccgccagcgccagcggccccgagggcagcggcgacaccagcaccagcccccccgtgaccacccagggccccaccccccccgagaccacccccgagccccacaccaccatcgacatcgacaagagcagcaccgccatcgccgacatcagcacccagaccgtgaagaacatccccacccccaccgcccacaccagcctgcccagcaccctgagcgcccccaccatgccccaggaggcccaccacaccgccagaggcctgctgagcgtgaccagcaccaagcccggcgaggccagcacccccaccagccccggcgaggccagcaccgaggccagcagcccccagcccaccatcagagagacccccagccccccccccaccacccagacccccaccgagatcaacaaccccaacaccagcagacagcccatgcccagcacccagcccgccgcccccagcagcgtgacccaccccgcccagcccacccccagccagagcgacgtgcccaccgccgcccaggacatccaccccagccccaccaacagaagcaagagaaacctggagatggagatcatcctgaccctgagccagggcctgaagaagtactacggcaaggtgctgaagctgctggacctgaccctggaggaggacaccgagggcctgctggagtggtgcaagagaaacctgggcctgacctgcgacgacaacttcttccagaagagaatcgaggagttcttcctgaccggcgagggccacttcaacgaggtgctgcagttcaagacccccagcaccctgagccccaccgagcccgccagagtggagagccccaccgtggagcccttcaagagctacttcgccaagggcttcctgctgatggacagcggctacttcagcgccaagtgctaccccaagagcagcaacagcggcctgcagctgatcaacgtgacccagcacctgatcagaatcaccgacacccccggccccaagatcaccaacctgaagaccatcaactgcatcaacctgaaggccctggtgttcaaggagcacagagagatcgagatcaacgtgctgctgccccaggtggccgtgaacctgagcaactgccacgtgctgatcaagagccacgtgtgcgactacagcatcgacatcgacggccccgtgagactgcccagaatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagccacggcgagaccgtggaggtgtaccagaccagagagggctacaccagcatctgcctgttcgtgctgggcagcatcctgttcctggtgagctgcctgatgagaggcctggtggacagcgtgagcaacagcttcttccccggcctgagcatctgcaagacctgcagcatcggcagcatcaacggcttcgagatcgagagccacaagtgctactgcagcctgttctgctgcccctactgcagacactgcagcgccgacatcgagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcatcaagagcttcttctacggcctgaagaacatgctgagcggcatcttcggcaacgtgttcatcggcatcttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggctga

SEQ ID NO: 8760 - RNA, 5052 nt, synthetic construct
  misc_feature 1..5052: note = derived and/or modified CDS sequence (opt4) from CCHFV(K323_27)__KX013472.1__GP
  source 1..5052: mol_type = other RNA
atgcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccctgcccggcaccacccccgagagaagcgccaccaccgccaccagcaccagcagcaccgacaacatgaacagcaccacccaggtgaccgacaacacccccaccagcaccgtgagcatcagccccagcagcagccccagcatgcccagcaccagccagggcatccaccaccccgtgagaagcctgctgagcgtgagcagccccaagaccgtgaccacccccacccccatgagccccggcgagatgagccccgagaccagcagccagcacagcgccatgagcagaatccccaccctgtacaccgccacccaggtgagcaccgagaacaccgacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagagcagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcagcagccacgtgtgcgactacagcctggacaccgacggccccgtgagactgcccagaatccaccacgagggcaccttcatccccggcacctacaagatcgtgatcgacagaaaggacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacctgctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgaccgtgctgctggtgctgctgaccgtgagcctgagccccgtgcagagcgcccccgtgggccacggcaacaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccccactgcagacacagaagcgccgacagagagatccaccagctgcacctgagcatctgcaagaagagaaagaccggcagcaacgtgatgctggccgtgtgcaagagaatgtgccccaaggccaccatcgaggccagcagaagagccctgcccatcagaagcatcatcaacaccaccctggtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccggccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaacgacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8761 - RNA, 5052 nt, synthetic construct
  misc_feature 1..5052: note = derived and/or modified CDS sequence (opt4) from CCHFV(1231-CR/TI-2015)__KU161585.1__GP
  source 1..5052: mol_type = other RNA
atgcacaccctgctggtgtgcttcatcctgtacctgcagctgctgggcctgggcggcgcccacgagcagagcaacgccaccgaccacaacagaaccaacaccatcaccgcccccagcaccagccagaaccccaagccccccgccagcaccacccccccccacacccccgagagcagcaccatcaagctgatcaccagcaccggcgaggccgagggcagcggcgagaccaccccccccctgaacaccacccagggccccttcccccccgagaccaccagcgagcaccccgccagcaccgccaccaacaccagcagcaccaacagcatgaacagcaccacccagatgaccgacaagaccctgaccagcaccgtgagcaccagcctgagcatcagccccagcacccccagcaccagccagggcatccactaccccatcagaagcctgctgagcgtgagcagccccagaaccgccgccacccccacccccatgagcaccagagagatgagcagcgagaccaacagccagcacagcgccgtgagcagaacccccaccttccacaccgccacccaggtgagcaccgagaacgacaacagaagcacccccagacagagcgagagcagcgcccagcccgccacccagagccccatgaccagccccgcccagagcatcctgctggtgagcgccgcccccaccaccatccagaacatccaccccagccccaccaacagaagcaagagaaacctggagatggagatcatcctgaccctgccccagggcctgaagaagtactacggcaagatcctgaagctgctgcacctgaccctggaggaggacaccgagggcctgctggagtggtgcaagagaaacctgggcagcaactgcgacgacgagttcttccagaagagaatcgaggagttcttcatcaccggcgagggctacttcaacgaggtgctgcagttcaagaccctgagcaccctgagccccatggagcccagccacgccagaccccccaccgccgagcccttcaagagctacttcgccaagggcttcctgagcatcgacagcggctacttcagcgccaagtgctaccccagaagcagcagcagcggcctgcagctgatcaacatcacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatccccggcacctacaagatcgtgatcgacaagaagaacaagctgaacgacagatgcaccctggtgaccaactgcgtgaccaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggagagcgtgagcgacagcttcttccccggcctgagcgtgtgcagaacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8762 - RNA, 5052 nt, synthetic construct
  misc_feature 1..5052: note = derived and/or modified CDS sequence (opt4) from CCHFV(K229_194)__KX013463.1__GP
  source 1..5052: mol_type = other RNA
atgcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccccccccggcaccacccccgagagacccgccaccaccgccaccagcaccagcagcaccgacaacatgaacagcaccacccaggtgaccgacaacacccccatcagcaccgtgagcatcagccccagcagcagccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccacccaggtgagcaccgagaacaccaacagaagcacccccagacagagcgagagcagcgcccagcccgccacccagagccccaccaccagccccacccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgaacaccctgagccccaccgagcccagccacgtgagactgcccaccgccgagcccttcaagagctacttcgccaagggcttcctgagcgtggacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaagggcaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccagcttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacagctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggctga

SEQ ID NO: 8763 - RNA, 5052 nt, synthetic construct
  misc_feature 1..5052: note = derived and/or modified CDS sequence (opt4) from CCHFV(K315_14)__KX013469.1__GP
  source 1..5052: mol_type = other RNA
atgcacaccctgctggtgtgcttcatcctgtacctgcagctgagcggcctgggcggcgcccacggccagagcaacgagaccgagcacaacggcaccaacaccaccaccgtgcccggcaccagccagagccccaagccccccgccagcaccaccctgcagcacacccccgagagcagcaccgtgaagctgaccacccccaccagcgagaccgagggcagcggcgagaccacccccccccccaacaccacccagggcctgcccccccccggcaccacccccgagagaagcgccaccaccgccaccagcaccagcagcaccgacaacatgaacagcaccacccaggtgaccgacaacacccccaccagcaccgtgagcatcagccccagcagcagccccagcatgcccagcaccagccagggcatccactaccccatcagaagcctgctgagcgtgagcagccccaagaccgtgaccacccccacccccatcagccccggcgagatgagccccgagaccagcagccagcacagcgccatgagcagaatccccaccctgtacaccgccacccaggtgagcaccgagaacaccaacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcagaatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccgtggtggaccagagactgggcagcgagctgggctgctacaccatcaacagagtgaagagcttcaagctgtgcaagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgagggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtgtacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaagctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8764 - RNA, 5055 nt, synthetic construct
  misc_feature 1..5055: note = derived and/or modified CDS sequence (opt4) from CCHFV(BA8402)__AF350449.1__GP
  source 1..5055: mol_type = other RNA
atgtacacccccctgctgtgcgccgtgctgtgcctgcagctgtggagcctggagggcagccacggcctgagcaacaagacccagcacagcaacaccagcaccaccaaggcccccgaggtgagccaggagctgggcctgcccgtgagcaccgtgagcaccatcaccagcgagccccccagcatcaccagcgccgtgagcgtgagcggcagcgagggcagcggcgacaccaacaccagccccagcgtgaccacccagggccccaccctgcccgagaccaccctggagcccctgaccaccaccgacaccgacgccagcagcaccgtggtggtggacgtgagcacccagaccgtgaaggacacccccatcagcaccacctacaccagcctgcccagcacccccagcgagcccaccaccccccagggcacccaccacaccgccagaggcctgctgagcgtgaccagcaccaagcccgaggaggccagcccccaggccaaccccggcaagatcagcatggagaccaacggccccagactggccatcagcgagacccccagcttcagccccaccacccaggcccccaccgagaacagcaaccccatcaccagcaagcagctgatgctgagcgcccagcccgtgacccccaaccccatgaccagccccgtgcagcccgccctgagccagagcgacaccagcaccgccatccaggacgtgcaccccagccccaccggcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacaacttcttccagaagagaatcgaggagttcttcctgaccggcaagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaagatcaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagatcgtgatcgacaagaagaacaagcagaacgacagatgcaccctggtgaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgctgagaaccgagaccgccgagatccacaacgacaactacggcggccccggcgacaagatcaccatctgcaacggcagcaccgtggtggaccagagactgggcagcgagctgggctgctacaccatcaacagagtgaacagcttcaacctgtgcgagaacaccgccaccggcaagagctgcgagatcgacagcacccccgtgaagtgcagacagggcttctgcctgaagatcacccaggagggcagaggccacgtgaagctgagcagaggcagcgaggtggtgctggacgcctgcgagagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagacccaccagcgacggcctggccagacacgtgatgcagtgccccaagagaaaggagaagatcgaggagaccgccctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacagactgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctgcactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagagcaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8765 - RNA, 5055 nt, synthetic construct
  misc_feature 1..5055: note = derived and/or modified CDS sequence (opt4) from CCHFV(UCCR4459)__KY484032.1__GP
  source 1..5055: mol_type = other RNA
atgtacacccccctgctgtgcgccgtgctgtgcctgcagctgtggagcctggagggcagccacggcctgagcaacaagacccagcacagcaacaccagcaccaccaaggcccccgaggtgagccaggagttcggcctgcccgtgagcaccgtgagcaccatcaccagcgacccccccagcatcaccagcgccgtgagcgtgagcggcagcgagggcagcggcgacaccaacaccagccccagcgtgaccacccagggcctgaccctgcccgagaccaccctggagctgctgaccaccaccgacaccgacgccagcagcaccgtggtggtggacgtgagcacccagaccgtgaaggacacccccatcagcaccacccacaccagcctgcccagcacccccagcgccaccaccaccccccagggcacccaccacaccgccagaggcctgctgagcgtgaccagcaccaagcccgagggcgccagcacccaggccaaccccgagaagatcagcatggagaccaacagccccagactggccatcagcgagacccccagcttcagccccaccacccaggcccccaccgagaacagcaaccccatcaccagcaagcagctgatcttcagcgcccagcccgtgacccccaaccccgtgaccccccccgtgcagcccgccctgagccagagcgacaccagcaccgccatccaggacatccaccccagccccaccagcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacgacttcttccagaagagaatcgaggagttcttcctgaccggcgagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaaggtgaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagctggtgatcgacaagaagaacaagcagaacgacagatgcaccctgatcaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgagcagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccatcaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8766 - RNA, 5052 nt, synthetic construct
  misc_feature 1..5052: note = derived and/or modified CDS sequence (opt4) from CCHFV(Ast149)__KX056054.1__GP
  source 1..5052: mol_type = other RNA
atgcacaccctgctggtgtgcttcatcctgtacctgcagctgagcggcctgggcggcgcccacggccagagcaacgccaccgagcacaacggcaccaacaccaccaccgcccccggcaccagccagagccccaagccccccgccagcaccacccccccccacacccccgagagcagcaccgtgaagctgaccacccccaccagcgagaccgagggcagcggcgagaccacccccccccccaacaccacccagggcctgcccccccccggcaccacccccgagagacccgccaccaccgccaccagcaccagcagcaccgacaacatgaacagcaccacccaggtgaccgacaacacccccaccagcaccgtgagcaccagccccagcagcagccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccgcccaggtgagcaccgagaacgccaacagaagcacccccagacagagcgagagcagcgcccagcccgccacccagagccccaccaccttccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatctacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgcccatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggccctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggctga

SEQ ID NO: 8767 - RNA, 5052 nt, synthetic construct
  misc_feature 1..5052: note = derived and/or modified CDS sequence (opt4) from CCHFV(Ast137)__KX056057.1__GP
  source 1..5052: mol_type = other RNA
atgcacaccctgctggtgtgcttcatcctgtacctgcagctgagcggcctgggcggcgcccacggccagagcaacgccaccgagcacaacggcaccaacaccaccaccgtgcccggcaccagccagagccccaagccccccgccagcaccaccctgccccacacccccgagagcagcaccgtgaagctgaccacccccaccagcgagaccgagggcagcggcgagaccacccccccccccaacaccacccagggcctgcccccccccggcaccacccccgagagacccgccaccaccgccaccagcaccagcagcaccgacaacatgaacagcaccacccaggtgaccgacaacacccccaccagcaccgtgagcatcagccccagcagcagccccagcatgcccagcaccagccagggcatccactaccccgtgagaagcctgctgagcgtgagcagccccaagaccgtgaccacccccacccccatgagccccggcgagatgagccccgagaccagcagccagcacagcgccatgagcagaatccccaccctgtacaccgccgcccaggtgagcaccgagaacaccaacagaagcacccccagacagagcgagagcagcgcccagcccgccacccagagccccaccaccttccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacaagaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatccacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctacctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaccaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggctga

SEQ ID NO: 8768 - RNA, 5055 nt, synthetic construct
  misc_feature 1..5055: note = derived and/or modified CDS sequence (opt4) from CCHFV(C-68031)__DQ211629.1__GP
  source 1..5055: mol_type = other RNA
atgtacacccccctgctgtgcgccgtgctgtgcctgcagctgtggagcctggagggcagccacggcctgagcaacaagacccagcacagcaacaccagcaccaccaaggcccccgaggtgagccaggagttcggcctgcccgtgagcaccgtgagcaccatcaccagcgacccccccagcatcaccagcgccgtgagcgtgagcggcagcgagggcagcggcgacaccaacaccagccccagcgtgaccacccagggcctgaccctgcccgagaccaccctggagctgctgaccaccaccgacaccgacgccagcagcaccgtggtggtggacgtgagcacccagaccgtgaaggacacccccatcagcaccacccacaccagcctgcccagcacccccagcgcccccaccaccccccagggcacccaccacaccgccagaggcctgctgagcgtgaccagcaccaagcccgagggcgccagcacccaggccaaccccgagaagatcagcatggagaccaacagccccagactggccatcagcgagacccccagcttcagccccaccacccaggcccccaccgagaacagcaaccccatcaccagcaagcagctgatcctgagcgcccagcccgtgacccccaaccccgtgaccccccccgtgcagcccgccctgagccagagcgacaccagcaccgccatccaggacatccaccccagccccaccagcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgacgacttcttccagaagagaatcgaggagttcttcctgaccggcgagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaaggtgaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagctggtgatcgacaagaagaacaagcagaacgacagatgcaccctgatcaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgagcagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccatcaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcatcaacggcttcgagaccgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8769 - RNA, 5052 nt, synthetic construct
  misc_feature 1..5052: note = derived and/or modified CDS sequence (opt4) from CCHFV(K340_6)__KX013475.1__GP
  source 1..5052: mol_type = other RNA
atgcacaccctgctggtgtgcttcatcctgtacctgcagctgagcggcctgggcggcgcccacgtgcagagcaacgccaccgagcacaacggcaccaacaccaccaccgcccccggcaccagccagagccccaagccccccgccagcaccaccctgccccacacccccgagagcagcaccgtgaagcccaccacccccaccagcgagaccgagggcagcggcgagaccacccccccccccaacaccacccagggcctgccccccaccggcaccacccccgagagaagcgccaccaccgccaccagcaccagcagcaccgacaacatgaacagcaccacccaggtgaccgacagcacccccaccagcaccgtgagcaccagccccagcagcagcagcagcatgcccagcaccagccagggcatccaccaccccgtgagaagcctgctgagcgtgagcagccccaagaccgtgaccacccccacccccatgagccccggcgagatgagccccgagaccagcagccagcacagcgccatgagcagagtgcccaccctgtacaccgccacccaggtgagcaccgagaacaccgacagaagcacccccagacagagcgagagcagcgtgcagcccgccacccagagccccatcaccagccccgcccagaccatcctgctgatgagcgccgcccccaaggccatccaggacatgcaccccagccccaccaacagaagcaagagaaacctggaggtggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcaccctgagccccaccgagcccagccacgtgagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatccaccacgagggcaccttcatccccggcacctacaagatcgtgatcgacagaaagaacaagctgaacgacagatgcagcctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcaccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatcccccccctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgagcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtgaccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacttcaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8770 - RNA, 5055 nt, synthetic construct
  misc_feature 1..5055: note = derived and/or modified CDS sequence (opt4) from CCHFV(Hy13)__AY900145.1__GP
  source 1..5055: mol_type = other RNA
atgtacacccccctgctgtgcgccgtgctgtgcctgcagctgtggagcctggagggcagccacggcctgagcaacaagacccagcacagcaacaccagcaccaccaaggcccccgaggtgagccaggagttcggcctgcccgtgagcaccgtgagcaccatcaccagcgacccccccagcatcaccagcgccgtgagcgtgagcggcagcgagggcagcggcgacaccaacaccagccccagcgtgaccacccagggcctgaccctgcccgagaccaccctggagctgctgaccaccaccgacaccgacgccagcagcaccgtggtggtggacgtgagcacccagaccgtgaaggacacccccatcagcaccacccacaccagcctgcccagcacccccagcgccaccaccaccccccagggcacccaccacaccgccagaggcctgctgagcgtgaccagcaccaagcccgagggcgccagcacccaggccaaccccgagaagatcagcatggagaccaacagccccagactggccatcagcgagacccccagcttcagccccaccacccaggcccccaccgagaacagcaaccccatcaccagcaagcagctgatcttcagcgcccagcccgtgacccccaaccccgtgaccccccccgtgcagcccgccctgagccagagcgacaccagcaccgccatccaggacatccaccccagccccaccagcagaagcaagagaaacctggagatggagatcatcctgaccctgagccagggcctgaagaagtactacggcaagatcctgaagctgctggacctgaccctggaggaggacaccgagggcctgctggagtggtgcaagagaaacctgggcctggtgtgcgacgccgacttcttccagaagagaatcgaggagttcttcctgaccggcgagggccacttcaacgaggtgctgcagttcaagacccccagcaccctgagccccaccggccccgccagaaccggcagccccaccgtggagcccttcaagagctacttcgccaagggcttcctgagcatggacagcggctacttcagcgccaagtgctaccccagagccagcaacagcggcctgcagctgatcaacgtgacccagcacagcaccagaatcaccgacacccccggccccaaggtgaccaacctgaagaccatcaactgcatcaacctgaaggccagcgtgttcaaggagcacagagagatcgagatcaacgtgctgctgccccaggtggccgtgaacctgagcagctgccacgtgctgatcaagagccacgtgtgcgactacagcctggacatcgacggccccgtgagactgcccagaatccaccacgagggcaccttcatccccggcacctacaagctggtgatcgacaagaagaacaagcagaacgacagatgcaccctgatcaccaactgcgtgatcaagggcagagagatcagaaagggccagagcgtgctgagacagtacagaaccgagatcaagatcggcaaggccagcagcggcagcagaagactgctgagcgaggagagcggcgacgactgcatcagcagaacccagctgagcagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccatcaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcagcagcatctgcaagacctgcagcatcggcagcatcaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggccaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggctga

SEQ ID NO: 8771 - RNA, 5052 nt, synthetic construct
  misc_feature 1..5052: note = derived and/or modified CDS sequence (opt4) from CCHFV(4574-ST-2008)__KR814870.1__GP
  source 1..5052: mol_type = other RNA
atgcacaccctgctggtgtgcttcatcctgtacctgcagctgctgggccccggcggcgcccacggccagcccaacgccaccgagcacaacagaaccaacaccaccaccgcccccagcaccagccagagccccaagccccccgtgagcaccgcccccccccacgccctggagagccccaccatcaagagcaccacccccaccagcgagaccgagggcagcggcgagaccaccagcccccccaacaccacccagggccccagcctgcccgagaccacccccaagagacccgccaccaccgccaccagcacccccagcaccgacaacaccaacagcaccacccacgtgaccgacaacaaccccaccagcaccatcagcaccagccccagcagcagccccagcacccccagcacccccagaggcatccaccaccccgccagaaacctgctgagcgtgagcagccccaagaccgccaccacccccacccccaccagccccggcgagatcagcagcgagaccagcagcctgcacagcgccatgagcagaaccagcaccctgtacaccgccacccaggccagcaccgagaacgccaaccacagcgcccccagacagagcgagagccccgcccagcccaccaccaccagcctgatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgaggacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggtgagcaccggcagcagaaagctgctgagcgaggagagcggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcctgttctgcaaggccctgttctacagcctgatcatcatcggcaccctgggcaagaagatcaagcagtacagagagctgagaccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagagccagaggcctgctgaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggctga

SEQ ID NO: 8772 - RNA, 5052 nt, synthetic construct
  misc_feature 1..5052: note = derived and/or modified CDS sequence (opt4) from CCHFV(75-ST-2010)__KR814864.1__GP
  source 1..5052: mol_type = other RNA
atgcacaccctgctggtgtgcttcatcctgtacctgcagctgctgggccccggcggcgcccacggccagcccaacgccaccgagcacaacagaaccaacaccaccaccgcccccagcaccagccagagccccaagccccccgtgagcaccgcccccccccacgccctggagagccccaccatcaagagcaccacccccaccagcgagaccgagggcagcggcgagaccacccccccccccaacaccacccagggccccagcctgcccgagaccacccccgagagacccgccaccaccgccaccagcacccccagcaccgacaacaccaacagcaccacccacgtgaccgacaacaaccccaccagcaccatcagcaccagccccagcagcagccccagcacccccagcacccccagaggcatccaccaccccgccagaaacctgctgagcgtgagcagccccaagaccgccaccacccccacccccaccagccccggcgagatcagcagcgagaccagcagcctgcacagcgccatgagcagaaccagcaccctgtacaccgccacccaggccagcaccgagaacgccaaccacagcgcccccagacagagcgagagccccgcccagcccaccaccaccagcctgatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggtgagcaccggcagcagaaagctgctgagcgaggagagcggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcctgttctgcaaggccctgttctacagcctgatcatcatcggcaccctgggcaagaagatcaagcagtacagagagctgagaccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagagccagaggcctgctgaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggctga

SEQ ID NO: 8773 - RNA, 5052 nt, synthetic construct
  misc_feature 1..5052: note = derived and/or modified CDS sequence (opt4) from CCHFV(37-R-2013)__KR814858.1__GP
  source 1..5052: mol_type = other RNA
atgcacaccctgctggtgtgcttcatcctgtacctgcagctgctgggcctgggcggcgcccacagacagagcaacgccaccgagcacaacggcaccaacaccaccaccgcccccagcaccagccagagccccaagccccccgtgagcaccgcccccccccacgcccccgagaccagcaccatcaagcccaccacccccgccagcgagaccgagggcagcggcgagaccacccccccccccaacaccacccagggccccagcccccccgaggccacccccgagagacccgccaccaccgtgaccagcacccccagcaccgacaacaccaacagcaccacccacgccaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgacatcagcagcgagaccagcagcctgcacagcgccatgagcagaacccccaccctgcacaccgccacccaggccagcaccgagaacgccaaccacagcgcccccagacagagcgagagcagcgcccagcagaccaccaccagccccatgaccagccccgcccagcccatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagactgaccaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcgtgtgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggacgacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgtgacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8774 - RNA, 5052 nt, synthetic construct
  misc_feature 1..5052: note = derived and/or modified CDS sequence (opt4) from CCHFV(Kashmanov)__DQ211631.1__GP
  source 1..5052: mol_type = other RNA
atgcacaccctgctggtgtgcttcatcctgtacctgcagctgctgggcctgggcggcgcccacggccagagcaacgccaccgagcacaacggcaccaacaccaccaccgcccccagcaccagccagagccccaagcccctggtgagcaccgcccccccccacgccctggagagcagcaccatcaagcccaccacccccgccagcgagaccgagggcagcggcgagaccacccccccccccaacaccacccagggccccagcccccccgagaccacccccgagagacccgccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgagatcagcagcgaggccagcagcctgcacagcgccatgagcagaaccagcaccctgtacaccgccacccaggtgagcaccgagaacgccaaccacagcgcccccagacagagcgagagcagcgcccagcccaccaccaccagccccatgaccagccccgcccagagcatcctggtgatgagcgccgcccccatcgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccggcccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcaccatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacagcctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8775 - RNA, 5052 nt, synthetic construct
  misc_feature 1..5052: note = derived and/or modified CDS sequence (opt4) from CCHFV(Haskovo-V46/13)__KR092379.1__GP
  source 1..5052: mol_type = other RNA
atgcacaccctgctggtgtgcttcatcctgtacctgcagctgctgggcctgggcggcgcccacggccagagcaacaccaccgagcacaacggcaccaacaacaccaccgcccccggcaccagccagagccccaagccccacatgagcaccacccccccccacgcccccgagagcagcaccatcaagcccaccacccccaccagcgagaccgagggcagcggcgagaccaccccccccagcaacaccacccagggccccagcccccccgagaccaccagcgagagacccgccaccaccgccatcagcaccagcagcaccgacaacatgaaccccaccagccagatgaccgacaacacccccaccagcaccgtgagcatcagccccagcagcagccccagcacccccagcaccccccagggcatgcaccaccccgccagaagcctgctgagcgtgagcagccccaagaccgccaccacccccacccccaccagccccgtggaggtgggcagcgagaccagcagccagcacagcgccatgagcagcacccccaccccccacaccgccacccaggtgagcaccgagaacaccaaccacagcacccccagacagagcgagcccagcgcccagcagaccacccccagccccatgcccagccccgcccagagcaccctgctgatgagcgccgcccccaccgccgtgcagaacacccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccatggagcccagccacgccgagctgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaaggccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagctgggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagaggcaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgcccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgggcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgccatgtgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccggcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccaagctggagcagccccagagcatcctgatcgagcacaagggcaccatcatcggcaagcagaacgacacctgcaccgccagagccagctgctggctggagagcgtgaagagcttcttctacggcctgaagaacatgctgggcagcgtgttcggcaacttcctgatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8776 - RNA, 5052 nt, synthetic construct
  misc_feature 1..5052: note = derived and/or modified CDS sequence (opt4) from CCHFV(Min)__KX013481.1__GP
  source 1..5052: mol_type = other RNA
atgcacaccctgctggtgtgcttcatcctgtacctgcagctgctgggcctgggcggcgcccacggccagagcaacgccaccgagcacaacggcaccaacaccaccaccgcccccagcaccagccagagccccaagcccctggtgagcaccgcccccccccacgccctggagagcagcaccatcaagcccaccacccccgccagcgagaccgagggcagcggcgagaccacccccccccccaacaccacccagggccccagcccccccgagaccacccccgagagacccgccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagcctgaagaccgccaccacccccacccccaccagccccggcgagatcagcagcgagaccagcagcctgcacagcgccatgagcagaaccagcaccctgtacaccgccacccaggtgagcaccgagaacgccaaccacagcgcccccagacagagcgagagcagcgcccagcccaccaccaccagccccatgaccagccccgcccagagcatcctggtgatgagcgccgcccccatcgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcaccatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaccaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8777 - RNA, 5052 nt, synthetic construct
  misc_feature 1..5052: note = derived and/or modified CDS sequence (opt4) from CCHFV(Kosovo/9553/2001)__AY675511.1__GP
  source 1..5052: mol_type = other RNA
atgcacaccctgctggtgtgcttcatcctgtacctgcagctgctgggcctgggcggcgcccacggccagagcaacgccaccgagcacaacggcaccaacaccaccaccgcccccggcaccagccagagccccaagccccccgccagcaccacccccagccacgcccccgagagcagcaccatcaagctgaccacccccaccagcgagaccgagggcagcggcgagaccaccccccccaccagcaccacccagggcagcccccccctggagaccacccccgagagaagcaccaccaccgccaccagcaccagcggcaccgacaacatgaacagcaccacccagatgaccgacaacacccccaccctgaccgccagcaccagccccagcagcagccccagcacccccagcaccagccagggcctgcactaccccgtgagaagcctgctgagcgtgagcagccccaagaccgtgaccacccccacccccatgagccccggcgagatgagcagcgagaccagcagccagcacagcgccatgagcagaacccccaccccccacaccgccacccaggtgagcaccgagaacgccaacagaagcaccagcagacagagcgagagcagcgcccagcccgccacccagagccccgtgaccagccccgcccagagcatcctgctgatgagcgccacccccaccaccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatcaccggcgagggctacttcaacgaggtgctgcagttcaagaccctgagcacccccagccccaccgagcccagccacgccagactgcccaccgccgagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagatcaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatgcccggcacctacaagatcgtgatcgacagaaagaacaagctgaacgacagatgcaccctggtgaccaactgcgtgatcaagggcagagaggtgagaaagggccagagcgtgctgagacagtacaagaccgagatcaagatcggcaaggcccccaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatcgccagaatgagcaaccaccccaagaccaccatggccttcctgttctggttcagcctgggctacgtgatcacctgcatcctgtgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgaagcagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggccagcaccagcgccgtggagatggagaccctgcccgccgccacctgggagagagaggaggacctgaccaacttctgccaccaggagtgccaggtgcccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcaagagctgcagcgaggacgacaccaagaagtgcgtggacaccaagctggagcagccccagagcatcctgatcgagcacagaggcaccatcatcggcaagcccaacgacacctgccccgccaagaccagctgctggctggagagcgtgaagagcttcttctacggcctgaagaacatgctgggcagcgtgttcggcaacttcttcatcggcatcctgctgttcctggcccccttcttcctgtggatgctgagcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8778 - RNA, 5052 nt, synthetic construct
  misc_feature 1..5052: note = derived and/or modified CDS sequence (opt4) from CCHFV(4495-ST-2008)__KR814869.1__GP
  source 1..5052: mol_type = other RNA
atgcacaccctgctggtgtgcttcatcctgtacctgcagctgctgggccccggcggcgcccacggccagcccaacgccaccgagcacaacagaaccaacaccaccaccgcccccagcaccagccagagccccaagccccccgtgagcaccgcccccccccacgccctggagagccccaccatcaagagcaccacccccaccagcgagaccgagggcagcggcgagaccacccccccccccaacaccacccagggccccagcccccccgagaccacccccgagagacccgccaccaccgccaccagcacccccagcaccgacaacaccaacagcaccacccacgtgaccgacaacaaccccaccagcaccatcagcaccagccccagcagcagccccagcacccccagcacccccagaggcatccaccaccccgccagaaacctgctgagcgtgagcagccccaagaccgccaccacccccacccccaccagccccggcgagatcagcagcgagaccagcagcctgcacagcgccatgagcagaaccagcaccctgtacaccgccacccaggccagcaccgagaacgccaaccacagcacccccagacagagcgagagccccgcccagcccaccaccaccagcctgatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggtgagcaccggcagcagaaagctgctgagcgaggagagcggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcctgttctgcaaggccctgttctacagcctgatcatcatcggcaccctgggcaagaagatcaagcagtacagagagctgagaccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagagatgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagagccagaggcctgctgaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggctga

SEQ ID NO: 8779 - RNA, 5052 nt, synthetic construct
  misc_feature 1..5052: note = derived and/or modified CDS sequence (opt4) from CCHFV(Mamon)__KX013478.1__GP
  source 1..5052: mol_type = other RNA
atgcacaccctgctggtgtgcttcatcctgtacctgcagctgctgggcctgggcggcgcccacggccagagcaacaccaccgagcacaacggcaccaacaccaccaccgcccccagcaccagccagagccccaagcccctggtgagcaccgcccccccccacgccctggagagcagcaccatcaagcccaccacccccgccagcgagaccgagggcagcggcgagaccacccccccccccaacatcacccagggccccagcccccccgagaccacccccgagagacccgccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgagatcagcagcaagaccagcagcctgcacagcgccatgagcagaaccagcaccctgtacaccgccacccaggtgagcaccgagaacgccaaccacagcgcccccagacagagcgagagcagcgcccagcccaccaccaccagccccatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgagcgacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccgtggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaagaccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8780 - RNA, 5052 nt, synthetic construct
  misc_feature 1..5052: note = derived and/or modified CDS sequence (opt4) from CCHFV(81-R-2014)__KR814865.1__GP
  source 1..5052: mol_type = other RNA
atgcacaccctgctggtgtgcttcatcctgtacctgcagctgctgggcctgggcggcgcccacggccagagcaacgccaccgagcacaacggcaccaacaccaccaccgtgcccagcaccagccagagccccaagcccctggtgagcaccacccccccccacgccctggagagcagcaccatcaagcccaccacccccaccagcgagaccgagggcagcggcgagaccgcccccctgcccaacaccacccagggcccccccccccccgagaccacccccgagagacccgccaccaccgtgaccagcacccccagcaccgacaacaccaacagcaccatccacgtgaccgacaacaaccccaccagcaccatcagcaccagccccagcagcagccccagcacccccagcaccccccagggcatccaccaccccgccagaagcctgctgagcgtgagcagccccaagaccgccaccacccccacccccaccagccccggcgagatcaacagcgagaccagcagcctgcacagcgccatgagcagaacccccaccctgcacaccgccacccaggtgagcaccgagaacgccaaccacagcgcccccagacagagcgagagcagcgcccagcccaccaccaccagcctgatgaccagccccgcccagagcatcctgctgatgagcgccgcccccaccgccatccagaacacccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcggcgagttcttcatgaccggcgagggctacttcaacgaggtgctgcagttcaagaccctgagcaccctgagccccaccgagcccagccacgccagactgcccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8781 - RNA, 5052 nt, synthetic construct
  misc_feature 1..5052: note = derived and/or modified CDS sequence (opt4) from CCHFV(5180-R-2011)__KR814874.1__GP
  source 1..5052: mol_type = other RNA
atgcacaccctgctggtgtgcttcatcctgtacctgcagctgctgggcctgggcggcgcccacagacagagcaacgccaccgagcacaacggcaccaacaccaccaccgcccccagcaccagccagagccccaagccccccgtgagcaccgcccccccctacgcccccgagagcagcaccatcaagcccaccacccccgccagcgagaccgagggcagcggcgagaccacccccccccccaacaccacccagggccccagcccccccgaggccacccccgagagacccgccaccaccgccaccagcacccccagcaccgacaacaccaacagcaccacccacgccaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgacatcagcagcgagaccagcagcctgcacagcgccatgagcagaacccccaccctgcacaccgccacccaggccagcaccgagaacgccaaccacagcgcccccagacagagcgagagcagcgcccagcagaccaccaccagccccatgaccagccccgcccagcccatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagactgagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagagatcagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcgtgtgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8782 - RNA, 5052 nt, synthetic construct
  misc_feature 1..5052: note = derived and/or modified CDS sequence (opt4) from CCHFV(24-R-2012)__KR814856.1__GP
  source 1..5052: mol_type = other RNA
atgcacaccctgctggtgtgcttcatcctgtacctgcagctgctgggcctgggcggcgcccacagacagagcaacgccaccgagcacaacggcaccaacaccaccaccgcccccagcaccagccagagccccaagccccccgtgagcaccgcccccccccacgcccccgagagcagcaccatcaagcccaccacccccgccagcgagaccgagggcagcggcgagaccacccccccccccaacaccacccagggccccagcccccccgaggccacccccgagagaaccgccaccaccgccaccagcacccccagcaccgacaacaccaacagcaccacccacgccaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgacatcagcagcgagaccagcagcctgcacagcgccatgagcagaacccccaccctgcacaccgccacccaggccagcaccgagaacgccaaccacagcgcccccagacagagcgagagcagcgcccagcagaccaccaccagccccatgaccagccccgcccagcccatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagactgagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcgtgtgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8783 - RNA, 5052 nt, synthetic construct
  misc_feature 1..5052: note = derived and/or modified CDS sequence (opt4) from CCHFV(46-ST-2012)__KR814860.1__GP
  source 1..5052: mol_type = other RNA
atgcacaccctgctggtgtgcttcatcctgtacctgcagctgctgggcctgggcggcgcccacggccagagcaacgccaccgagcacaacggcaccaacaccaccaccgtgcccagcaccagccagagccccaagcccctggtgagcaccacccccccccacgccctggagagcagcaccatcaagcccaccacccccaccagcgagaccgagggcagcggcgagaccgcccccctgcccaacaccacccagggcccccccccccccgagaccacccccgagagacccgccaccaccgtgaccagcacccccagcaccgacaacaccagcagcaccatccacgtgaccgacaacaaccccaccagcaccatcagcaccagccccagcagcagccccagcacccccagcaccccccagggcatccaccaccccgccagaagcctgctgagcgtgagcagccccaagaccgccaccacccccacccccaccagccccggcgagatcaacagcgagaccagcagcctgcacagcgccatgagcagaacccccaccctgcacaccgccacccaggtgagcaccgagaacgccaaccacagcgcccccagacagagcgagagcagcgcccagcccaccaccaccagcctgatgaccagccccgcccagagcatcctgctgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagactgcccaccgtggagcccttcaagagctacttcgccaagggcttcctgagcgtggacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacgccaccttcgtgatctgcatcctgaccctgaccatctgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8784 - RNA, 5052 nt, synthetic construct
  misc_feature 1..5052: note = derived and/or modified CDS sequence (opt4) from CCHFV(ROS/HUVLV-100)__DQ206448.1__GP
  source 1..5052: mol_type = other RNA
atgcacaccctgctggtgtgcttcatcctgtacctgcagctgctgggcctgggcggcgcccacagacagagcaacgccaccgagcacaacggcaccaacaccaccaccgcccccagcaccagccagagccccaagcccctggtgagcaccgcccccccccacgccctggagagcagcaccatcaagcccaccacccccgtgagcgagaccgagggcagcggcgagaccacccccccccccaacaccacccagggccccagcccccccgaggccacccccgagagacccaccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgagatcagcagcgagaccagcagcctgcacagcgccatgagcagaaccagcaccctgtacaccgccacccaggtgagcaccgagaacgccaaccacagcgcccccagacagagcgagagcagcgcccagcagaccaccaccagccccatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagactgagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8785 - RNA, 5052 nt, synthetic construct
  misc_feature 1..5052: note = derived and/or modified CDS sequence (opt4) from CCHFV(Saf)__KX013487.1__GP
  source 1..5052: mol_type = other RNA
atgcacaccctgctggtgtgcttcatcctgtacctgcagctgctgggcctgggcggcgcccacggccagagcaacgccaccgagcacaacggcaccaacaccaccaccgcccccagcaccagccagagccccaagcccctggtgagcaccgcccccccccacgccctggagagcagcaccatcaagcccaccacccccgccagcgagaccgagggcagcggcgagaccacccccccccccaacaccacccagggccccagcccccccgagaccacccccgagagacccgccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgagatcagcagcgagaccagcagcctgcacagcgccatgagcagaaccagcaccctgtacaccgccacccaggtgagcaccgagaacgccaaccacagcgcccccagacagagcgagagcagcgcccagcccaccaccaccagccccatgaccagccccgcccagagcatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagaagcagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatccaccacgagggcaccttcatccccggcacctacaagatcgtgatcgacaaggagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcactacctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacatgaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgtgagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8786 - RNA, 5052 nt, synthetic construct
  misc_feature 1..5052: note = derived and/or modified CDS sequence (opt4) from CCHFV(52-R-2014)__KR814862.1__GP
  source 1..5052: mol_type = other RNA
atgcacaccctgctggtgtgcttcatcctgtacctgcagctgctgggcctgggcggcgcccacagacagagcaacgccaccgagcacaacggcaccaacaccaccaccgcccccagcaccagccagagccccaagccccccgtgagcaccgcccccccccacgcccccgagagcagcaccatcaagcccaccacccccgccagcgagaccgagggcagcggcgagaccacccccccccccaacaccacccagggccccagcccccccgaggccacccccgagagacccgccaccaccgccaccagcacccccagcaccgacaacaccaacagcaccacccacgccaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgacatcagcagcgagaccagcagcctgcacagcgccatgagcagaacccccaccctgcacaccgccacccaggccagcaccgagaacgccaaccacagcgcccccagacagagcgagagcagcgcccagcagaccaccaccagccccatgaccagccccgcccagcccatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagactgagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacgtgcccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcgtgtgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggacgacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccggctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8787 - RNA, 5052 nt, synthetic construct
  misc_feature 1..5052: note = derived and/or modified CDS sequence (opt4) from CCHFV(Turkey-Kelkit06)__GQ337054.1__GP
  source 1..5052: mol_type = other RNA
atgcacacccccctggtgtgcttcatcctgtacctgcagctgctgtgcctgggcggcgcccacggccagctgaacgccaccgagcacaacggcaccaacaacaccaccgcccccggcgccagccagagccccaagccccccatgagcaccacccccccccacgcccccgagagcagcaccatcaagcccaccacccccatcagcgaggccgagggcagcggcgagaccaccagcccccccaacaccacccagggcctgagcagccccgagaccaccagcgagagacccgccaccaccagcatcagcaccagcagcaccgacagcaccaaccccaccacccagatgaccgacaacacccccacccccaccgtgagcaccagccccagcagcagccccagcacccccagcaccccccagggcatccaccaccccgccagaagcctgctgagcgtgagcagccccaagaccgtgaccacccccacccccaccagccccggcgagatgagcagcgagaccagcagccagcacagcgccatgagcagaatccccaccccccacaccgccaccagagtgagcaccgagatcaccaaccacagaacccccagacagagcgagagcagcgcccagcagaccacccccagccccatgaccagccccgcccagagcatcctgctgatgagcgccgcccccaccgccgtgcaggacatccaccccagccccaccaacagaagcaagagaaacctggagaccgagatcatcctgaccctgagccagggcctgaagaagtactacggcaagatcctgaagctgctgcacctgaccctggagcaggacaccgagggcctgctggagtggtgcaagggcaacctgggcagcaactgcgacgacgacttcttccagaagagaatcgaggagttcttcatgaccggcgagtgctacttcaacgaggtgctgcagttcaagaccctgagcaccctgagccccaccgagcccagccacgccagactgcccaccgccgagcccttcaagagctacttcgccaagggcttcctgagcatcgacagcggctacttcagcgccaagtgctaccccagaagcagcgccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcttcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcagaatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagatctaccagaccagagagggcttcgccagcatctgcctgttcatgctgggcagcatcctgttcatcgtgagctgcctggtgaagggcctggtggacagcgtgagcgagagcttcttccccggcctgagcgtgtgcaagacctgcagcatcggcagcgtgaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggtgcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggagccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggccctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcggcatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggctga

SEQ ID NO: 8788 - RNA, 5052 nt, synthetic construct
  misc_feature 1..5052: note = derived and/or modified CDS sequence (opt4) from CCHFV(V42/81)__GU477490.1__GP
  source 1..5052: mol_type = other RNA
atgcacaccctgctggtgtgcttcatcctgtacctgcagctgctgggcctgggcggcgcccacgtgcagcccaacgccaccgagcacaacagaaccaacaccaccaccgcccccggcaccagccacagcctgaagcccctggtgagcaccacccccccccaggcccccgagagcagcaccatcaagcccaccacccccaccagcgagaccgagggcagcggcgaggccacccccctgagcaacaccatccaggcccccagcagccccgagaccaccagcgagagacccgccaccgccgtgatcagcaccagcggcaccgacagcaccaacagcaccacccagaccaccgacaacaaccccaccaccaccgtgggcaccagccccagcagcagccccagcacccccagcaccccccagggcatccaccaccacgccagaagcctgctgagcgtgaccagccccgagaccgtgaccacccccaagcccaccagccccagagagatgagcagcgagaccagcaaccagcacagcgccatgagcagaacccccacccaccacaccgtgacccaggtgagcaccgagaacaccagccacagcacccccagacagcccgagagcagcgcccagcccaccagcagcagccccatgaccagccccgcccagagcaccctgctgatgagcgccgcccccaccgccgtgcagagcatccaccccagccccaccaacagaagcaagagaaacctggagaccgagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagacccccagcaccgtgagccccaccgagcccagccacgccagactgcccaccgccgagcccttcaagagctacttcgccaagggcttcctgagcatcgacagcggctacttcagcgccaagtgctacagcagaagcagcaccagcggcctgcagctgatcaacgtgacccagcaccccgccagaatcgccgagacccccggccccaagaccaccagcctgaagaccatcaactgcatcaacctgagagccagcgtgttcaaggagaacagagagatcgagatcagcgtgctgctgccccagatcgccgtgaacctgagcaactgccacgtggtgatcaacagccacgtgtgcgactacagcctggacaccgacggccccgtgagactgcccagaatcaaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcaaggagcccggcgacgactgcatcagcagaacccagctgatgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaaggcctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctggagtgcccccacatccccctgctgggcaagctggccatctacatctgcagaatgagcaaccaccccagaaccaccatggccttcctgttctggttcggcttcggctacgtgatcacctgcatcctgtgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggtgctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcatcgtgaagggcctggtggacagcgtgagcgacagcttcttccccggcctgagcgtgtgcaagacctgcagcatcagcagcatcaacggcttcgagatcgagagccacaagtgctactgcagcctgttctgctgcccctactgcagacactgcagcgccgacagagagatccaccagctgcacctgagcatctgcagaaagagaagaaccggcagcaacgtgatgctggccgtgtgcaagagaatgtgcttcagagccaccatcgaggtgagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacatccagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcatcgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgagaccccccagctggacctgaaggccagacccgcctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagagcggcaccgacagcaccttcaaggccttcagcgccatgcccaagaccagcctgtgcttctacatcgtggagagagagtactgcaagagctgcagcgaggacgacacccagaagtgcgtggagaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggaggacgaggagaccggctacagaagaatcatcgagagactgaacagcaagaagggcaagaacagactgctggacggcgagagactggccgacagaaagatcgccgagctgttcagcaccaagacccacatcggctga

SEQ ID NO: 8789 - RNA, 5052 nt, synthetic construct
  misc_feature 1..5052: note = derived and/or modified CDS sequence (opt4) from CCHFV(75-R-2012)__KR814863.1__GP
  source 1..5052: mol_type = other RNA
atgcacaccctgctggtgtgcttcatcctgtacctgcagctgctgggcctgggcggcgcccacagacagagcaacgccaccggccacaacggcaccaacaccaccaccgcccccagcaccagccagagccccaagcccctggtgagcaccgcccccccccacgccctggagagcagcatcatcaagcacaccacccccgtgagcgagaccgagggcagcggcgagaccacccccccccccaacaccacccagggccccagccccctggagaccacccccgagagacccgccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagcctgaagaccgccaccacccccacccccaccagccccggcgagatcagcagcgagaccagcagcctgcacagcgccatgagcagaaccagcaccctgtacaccgccacccaggtgagcaccgagaacgccaaccacagcgcccccagacagagcgagagcagcgcccagcagaccaccaccagccccatgaccagccccgcccagagcatcctggtgatgagcgccgcccccaccgccatccagaacacccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaaacctgggcagcaactgcgacgacgacttcttccagaagagaatcgaggagttcttcatgaccggcgagggctacttcaacgaggtgctgcagttcaagaccctgagcacccagagccccaccgagcccagccacgccagaccccccaccgtggagcccttcaagagctacttcgccaagggcttcctgagcatcgacagcggctacttcagcgccaagtgctaccccagactgagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcgcccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtgaacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcctgtacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8790 - RNA, 5052 nt, synthetic construct
  misc_feature 1..5052: note = derived and/or modified CDS sequence (opt4) from CCHFV(VLG/TI29414)__AY179961.1__GP
  source 1..5052: mol_type = other RNA
atgcacaccctgctggtgtgcttcatcctgtacctgcagctgctgggcctgggcggcgcccacatccagagcaacgccaccgagcacaacggcaccaacaccaccaccgcccccagcaccagccagagccccaagcccctggtgagcaccgcccccccccacgccctggagagcagcaccatcaagcccaccacccccgtgagcgagaccgagggcagcggcggcaccacccccccccccaacaccacccagggccccagcccccccgaggccacccccgagagacccgccaccaccgccaccagcacccccagcaccgacaacaccaacagcaccacccacgtgaccgacaacaaccccaccagcaccatcagcaccagccccagcagcagccccagcacccccagcaccccccagggcatccaccaccccgccagaaacctgctgagcgtgagcagccccaagaccgccaccacccccacccccaccagccccggcgacatcagcagcgagaccagcagcctgcacagcgccatgagcagaaccagcaccctgtacaccgccacccaggtgagcaccgagaacgccaaccacagcgcccccagacagagcgagagcagcgcccagcagaccaccaccagccccatgaccagccccgcccagcccatcctggtgatgagcgccgcccccaccgccatccagaacatccaccccagccccaccaacagaagcaagagaaacctggagatggagatcatcctgaccctgagccagggcctgaagaagtactacggcaagatcctgaagctgctgcacctgaccctggaggaggacaccgagggcctgctggagtggtgcaagagaagcctgggcagcaactgcgacgacgacttcttccagaagagaatcgaggagttcttcatgaccggcgagggctacttcaacgaggtgctgcagttcaagaccctgagcaccctgagccccaccgagcccagccacgccagaccccccaccgtggagcccttcaagagctacttcgccaagggcttcctgagcatcgacagcggctacttcagcgccaagtgctaccccagactgagcaccagcggcctgcagctgatcaacgtgacccagcaccccgccagaatcgccgagacccccggccccaagaccaccagcctgaagaccatcaactgcatcaacctgagagccagcgtgttcaaggagcacagagagatcgagatcaacgtgctgctgccccagatcgccgtgaacctgagcaactgccacgtggtgatcaacagccacgtgtgcgactacagcctggacaccgacggccccgtgagactgccccacatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcagcagaaagctgctgagcgaggagcccggcgacgactgcatcagcagaacccagctgctgagagccgagcccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggaacgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccaacctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctgggaggtgggcaccggctgcacctgctgcggctggaacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcatgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtgatcgccgccagcaccagcctgatggccagaaagctggagttcggcaccgacagcaccttcaaggccttcagcgccatgcccaagaccagcctgtgcttctacatcgccgagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggctga

SEQ ID NO: 8791 - RNA, 5055 nt, synthetic construct
  misc_feature 1..5055: note = derived and/or modified CDS sequence (opt4) from CCHFV__KJ648916.1__GP
  source 1..5055: mol_type = other RNA
atgcacatcagcctgatgtacgccatcctgtgcctgcagctgtgcggcctgggcgagacccacggcagccacaacgagaccagacacaacaagaccgacaccatgaccacccccggcgacaaccccagcagcgagccccccgtgagcaccgccctgagcatcaccctggaccccagcaccgtgacccccaccacccccgccagcggcctggagggcagcggcgaggtgtacaccagcccccccatcaccaccggcagcctgcccctgagcgagaccacccccgagctgcccgtgaccaccggcaccgacaccctgagcgccggcgacgtggaccccagcacccagaccgccggcggcaccagcgcccccaccgtgagaaccagcctgcccaacagccccagcacccccagcaccccccaggacacccaccaccccgtgagaaacctgctgagcgtgaccagccccggccccgacgagaccagcacccccagcggcaccggcaaggagagcagcgccaccagcagcccccaccccgtgagcaacagaccccccaccccccccgccaccgcccagggccccaccgagaacgacagccacaacgccaccgagcaccccgagagcctgacccagagcgccacccccggcctgatgaccagccccacccagatcgtgcacccccagagcgccacccccatcaccgtgcaggacacccaccccagccccaccaacgccagcaaggccaacctgaagatggagatcatcctgaccctgagccagggcctgaagaagtactacggcaagatcctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccccgccggcctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactacagcctggacatcgacggcgccgtgagactgccccacatctaccacgagggcgtgttcatccccggcacctacaagatcgtgatcgacaagaagaacaagctgaacgacagatgcaccctgttcaccgactgcgtgatcaagggcagagaggtgagaaagggccagagcgtgctgagacagtacaagaccgagatcagaatcggcaaggccagcaccggcagcagaagactgctgagcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgagaagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaagggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtgggcgagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacagaagaatcgccgagctgttcagcaccaagacccacatcggctga

SEQ ID NO: 8792 - RNA, 3495 nt, synthetic construct
  misc_feature 1..3495: note = derived and/or modified CDS sequence (opt4) from CCHVF(CCHVF 10200)__U39455.2__Gn-NSm-Gc
  source 1..3495: mol_type = other RNA
agcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgagaagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggc

SEQ ID NO: 8793 - RNA, 3495 nt, synthetic construct
  misc_feature 1..3495: note = derived and/or modified CDS sequence (opt4) from CCHVF(CCHVF IbAr10200)__AF467768.2__Gn-NSm-Gc
  source 1..3495: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgagaagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaagggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtgggcgagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacagaagaatcgccgagctgttcagcaccaagacccacatcggc

SEQ ID NO: 8794 - RNA, 3495 nt, synthetic construct
  misc_feature 1..3495: note = derived and/or modified CDS sequence (opt4) from CCHVF(CCHVF Turkey-Kelkit06)__GQ337054.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcagaatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagatctaccagaccagagagggcttcgccagcatctgcctgttcatgctgggcagcatcctgttcatcgtgagctgcctggtgaagggcctggtggacagcgtgagcgagagcttcttccccggcctgagcgtgtgcaagacctgcagcatcggcagcgtgaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggtgcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggagccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggccctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcggcatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggc

SEQ ID NO: 8795 - RNA, 3498 nt, synthetic construct
  misc_feature 1..3498: note = derived and/or modified CDS sequence (opt4) from CCHVF(CCHVF SR3)__AJ538199.1__Gn-NSm-Gc
  source 1..3498: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggccacggcaagaccatcgagacctacagagtgagagaggagtacaccagcatctgcctgttcgtgctgggcagcatcctgttcatcgtgagcttcctgatgaagggcctggtggacggcgtgggcaacatcttcttccccggcctgagcgtgtgcaagacctgcagcatcggcagcatcaacggcttcgagatcgagagccacaagtgctactgcagcctgttctgctgcccctactgcagacactgcagcgccgacggcgagatccaccagctgcacctgagcatctgcaagaagagaaagaccggcagcaacgtgatgctggccgtgtgcaagagaatgtgcttcagagccaccatggaggtgagcaacaaggccctgttcatcagaagcatcatcaacaccaccttcgtgatgtgcatcctgaagggcgagttcgccgccgtgaagagcatccaccccatcgagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcaacaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8796 - RNA, 3498 nt, synthetic construct
  misc_feature 1..3498: note = derived and/or modified CDS sequence (opt4) from CCHVF(CCHVF UCCR4413)__KY484038.1__Gn-NSm-Gc
  source 1..3498: mol_type = other RNA
agcgagagcagcgccagcggctgcatcagcagaacccagatgatcaagagcgagaccgccgagatccacgacgacatctacggcggccccggcgagaagctgaccatctgcaacggcaccaccgtggtggaccagagactgggcagcgagctgggctgctacaccatcaacagaatcaagacctacaagctgtgcgagaacagcgtgaaggagaagacctgcgagatcgacagcgtgcccgtgaagtgcagacagggcctgtgcctgaagatcacccaggagggcagaggccacgtgaagctgagcagaggcagcgagatcgtgctggacatctgcgacagcagctgcgagctgatgatccccaagggcaccggcgacatcctggtggactgcagcggcggccagcagcacttcctgcaggacaacctggtggacctgggctgccccaacatccccctgctgggcaaggtggccatctacatctgcagaatgagcaaccaccccaagaccaccatggccttcctgttctggttcagcttcggctacgtgatcacctgcatcctgtgcaagatcctgttctacctgctgatcatcaccggcaccctgggcaagaagctgaagcagtacagagagctgaagccccagacctgcaccatctgcgagagcacccccgtgaacgccatcgacgccgagatgcacgacctgaactgcagctacaacatctgcccctactgcgccagcagactgaccagcgacggcctgatcagacacgtgaacctgtgccccaagagaaaggagaaggtggaggagaccgagctgtacctgaacctggagagaatcccctggttcgtgagaaagctgctgcaggtgagcgagagcaccggcgtggccctgaagagaagcagctggctgctgatcctggtgatcctgctgaccgtgagcatgagccccgtgcagagcgcccccatcaaccagcagagagccgtggaggcctaccaggccagagagggctacaccggcatctgcctgttcatcctgggcagcgtgctgttcatgaccagctggctgaccaagggcctgatcgacagcatcggcgacagcttcttccccggcctgttcgtgtgcaagacctgcagcatcggcagcatcaacggcttcgagatcgagagccacagatgctactgcagcctgctgtgctgcccctactgcagaacctgcagcgccgacaaggacagccaccagctgcacctgagcatctgcaagaagaagaaggccggcagcaacgtgatgctggccgtgtgcaagagaatgtgcttcaaggccaccatcgaggccagcaacagagtgctgctgatcagaagcatcatcaacaccaccttcatcatctgcatgctgatcctggtggtgtgcgtgatcagcaccagcgccgtggagatggaggacctgcccgccggcacctgggagagagaggaggacctgaccaacttctgccaccaggagtgccaggtgaccgagaccgagtgcctgtgcccctacgaggccttcgtgctgagaaagcccctgttcctgagcagcatcgtgaagggcaagaagaacctgctgaacagcgccagcctggagaccagcctgagcatcgaggccccctggggcgccatcaacgcccagagcaccttcaagcccaccatcagcaccgccaacatcgccctgagctggagcagcgtggagcacagaggcaacaaggtgctggtgagcggcagaagcgagagcatcatgaagctggaggagagaaccggcatcagctggaacctgggcgtggaggacgccagcgagagcagaatgctgaccgtgagcgtgatggacctgagccagatgtacctgcccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgcccagcgagatcgtgaccctgcaccccaagatcgaggagggcttcttcgacctgatgcacgtgcagaaggtgctgagcgccagcaccgtgtgcaagctgcagagctgcacccacggcgtggccggcgacctgcaggtgtaccacgtgggcaacctgctgaagggcgacaagatcaacggccacagcatccacaagatcgagccccacctgaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagagcttccacttccacagcaagagagtgaccgcccacggcgacaccccccagctggacctgaaggccagacccatgtacggcgccggcgagatcaccgtgctggtggaggtggccgacatggagctgcacagcaagaacatcgagatcagcggcctgaagttcgccagcctgacctgcagcggctgctacgcctgcagcagcggcatcagctgcaaggtgagaatccacgtggacgagcccgacgagctggccgtgcacgtgaagagcgacgacctggacgtggtggccgccagcagcagcctgatggccagaaagatcgagttcggcaccgacagcaccttcaaggccttcagcagcatgcccaaggagagcctgtgcttctacatcgtggagagagacttctgcaagagctgcgccgccgaggacacccagaagtgcgtgaaggccaagctggagcagccccagagcatcctgatcgagcacaagggcaccatcatcggcaagcagaacgacacctgcagcaccaagaccagctgctggctggagagcttcaagagcttcttctacggcctgaagaacatgctgagcggcgtgttcggcagcgccatcatgggcatcctgctgttcctggcccccttcatcctgctgatcctgttcttcttcttcggctggagaatcctgttctgcctgagatgctgcagaagaaccagaggcctgttcaagtacaagcacatcaaggacgacgaggaggccggctacaagaagatcatcgagaagctgaacaacaagaagggcggcaccagcaagctgctggacggcgagagactggccgacagaaagatcgccgagctgttcagcaccaaggcccacatcggc

SEQ ID NO: 8797 - RNA, 3495 nt, synthetic construct
  misc_feature 1..3495: note = derived and/or modified CDS sequence (opt4) from CCHVF(CCHVF 66019)__AB069669.1__Gn-NSm-Gc
  source 1..3495: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccatcgtggaccagagactgggcagcgagctgggctgctacaccatcaacagagtgaagagcttcaagctgtgcgagaacagcggcaccggcaagagctgcaagatcgacaacacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcttctgcaagatcatcttctacctgctgatcgtggtgggcaccctgggcaagaagttcaagcagtacagagagctgaagccccagacctgcaccatctgcgagaccacccccaccaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgaggcctaccagaccagagagggctacaccagcgtgtgcctgttcatgctgggcggcatcctgttcgtggtgagctgcctgatgaagggcctggtggacagcgtgagcaacagcttcttccccggcctgagcatctgcaagacctgcagcatcggcagcgtgaacggcttcgagatcgagagccacaagtgctactgcagcctgctgtgctgcctgtactgcagacactgcagcgccgacagagagatccaccagctgcacctgagcatctgcaagaagagaagagccggcggcaacgtgatgctggccgtgtgcaagagaatgtgcctgagagccaccatggaggtgagcaacaaggtgctgttcatcagaagcatcatcaacaccaccttcgtgatctgcatcctggtgctggccgtgtgcatcgtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcaactgccccgacagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaacagccaggagagacagtgcagcctgatcgaggccggcaccagattcaacctgggccccgtgaccatcaccctgagcgagcccagaaacatccagcagaagctgcccagcgagatcatcaccctgcaccccagaatcgaggagggcttcttcgacctgatgcacgtgcagaaggtgctgagcgccagcaccgtgtgcaagctgcagagctgcacccacggcgtgcccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgccatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagatacctgaaggacgacgaggagagcggctacagaagaatcatcgagagactgaacaacaagaagggcaagaacaagctgctggacggcgagagactggccgacagaagaatcgccgagctgttcagcaccaagacccacatcggc

SEQ ID NO: 8798 - RNA, 3495 nt, synthetic construct
  misc_feature 1..3495: note = derived and/or modified CDS sequence (opt4) from CCHVF(CCHVF 7001)__AB069670.1__Gn-NSm-Gc
  source 1..3495: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagagactgggcagcgagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggcaaggagagagccatcgagacctaccaggccagagagacctacaccggcatctgcctgttcgtgctgggcagcgtgctgttcgccgtgagctggctgaccaaggccctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagaacacccacagaatgcacctgaacgtgtgcaagaagagaaagatgggcagcaacgtgatgctggccgtgtgcaagagaatgtgcttcagagccaccatcgaggccagcaacaaggccctgctgatcagaagcatcatcaacagcaccttcgtgatctgcatcctgatcctgaccatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccatggtgctgagaaagcccctgttcctggacaacatcgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccaggtgtaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcttcctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggc

SEQ ID NO: 8799 - RNA, 3495 nt, synthetic construct
  misc_feature 1..3495: note = derived and/or modified CDS sequence (opt4) from CCHVF(CCHVF 75024)__AB069671.1__Gn-NSm-Gc
  source 1..3495: mol_type = other RNA
agcgaggagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagcatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccatcagcctgagccccgtgcagagcgcccccatcggccacggcaagaccatcgagacctaccaggccagagaggagtacaccagcatctgcctgttcgtgctgggcagcatcctgttcatcgtgagctgcctgatgaagggcctggtggacagcatcggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgagaggcatgaagaaccagctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgatcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacctgatccacaagatcgagccccacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagttcacccccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacctgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8800 - RNA, 3495 nt, synthetic construct
  misc_feature 1..3495: note = derived and/or modified CDS sequence (opt4) from CCHVF(CCHVF 7803)__AB069672.1__Gn-NSm-Gc
  source 1..3495: mol_type = other RNA
agcgaggagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtgatcctggacgcctgcgacagcagctgcgaggtgatgatccccaagggcaccggcgacatcctggtggactgcagcggcggccagcagcacttcctgaaggacaacctgatcgacctgggctgccccagcatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccatcagcctgagccccgtgcagagcgcccccatcagccacggcaagaccatcgagacctaccaggccagagaggagtacaccagcatctgcctgttcgtgctgggcagcatcctgttcatcgtgagctgcctgatgaagggcctggtggacagcatcggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgcctgcaagagaatgtgcttcagagccaccatggaggtgagcaacaaggccctgctgatcagaagcatcatcaacaccaccttcgtggtgtacatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgagaggcatgaagaaccccctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgatcgtgaagtggaaggtggagtacatcaagaccagaggcatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacctgatccacaagatcgagccccacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagttcacccccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacttcttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8801 - RNA, 3495 nt, synthetic construct
  misc_feature 1..3495: note = derived and/or modified CDS sequence (opt4) from CCHVF(CCHVF 79121)__AB069673.1__Gn-NSm-Gc
  source 1..3495: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagggcctgggcagcgagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggcaaggagagagccatcgagacctaccaggccagagagacctacaccggcatctgcctgttcgtgctgggcagcgtgctgttcgccgtgagctggctgaccaaggccctgatcgacggcatcggcaacagcttcagccccggcctgagcgtgtgcaagacctgcagcatcggcagcatcaacggcttcgagatcgagagccacaagtgctactgcagcctgttctgctgcccctactgcagagcctgcagcagcgacaagaacacccacagaatgcacctgaacgtgtgcaagaagagaaagatgggcagcaacgtgatgctggccgtgtgcaagagaatgtgcttcagagccaccatcgaggccagcaacaaggccctgctgatcagaagcatcatcaacagcaccttcgtgatctgcatcctgatcctgaccatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccatggtgctgagaaagcccctgttcctggacagcaccgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccagatctaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaacctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcttcctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggc

SEQ ID NO: 8802 - RNA, 3495 nt, synthetic construct
  misc_feature 1..3495: note = derived and/or modified CDS sequence (opt4) from CCHVF(CCHVF 8402)__AB069674.1__Gn-NSm-Gc
  source 1..3495: mol_type = other RNA
agcgaggagagcggcgacgactgcatcagcagaacccagctgctgagaaccgagaccgccgagatccacaacgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacagactgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagagcaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8803 - RNA, 3495 nt, synthetic construct
  misc_feature 1..3495: note = derived and/or modified CDS sequence (opt4) from CCHVF(CCHVF 88166)__AB069675.1__Gn-NSm-Gc
  source 1..3495: mol_type = other RNA
agcgaggagagcggcgacgactgcatcagcagaacccagctgctgagaaccgagaccgccgagatccacagcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatgggcttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacagactgcacctgagcatctgcaagaagagaaagacctggagcaacgtgatgctggccgtgtgcaagagaatgtgcttcagagccaccgtggaggtgagcaacaaggccctgctgatcagaaacatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctggaacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacctggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8804 - RNA, 3495 nt, synthetic construct
  misc_feature 1..3495: note = derived and/or modified CDS sequence (opt4) from CCHVF(CCHVF BA88166)__AF338470.1__Gn-NSm-Gc
  source 1..3495: mol_type = other RNA
agcgaggagagcggcgacgactgcatcagcagaacccagctgctgagaaccgagaccgccgagatccacagcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatgggcttcctgttctggttcagcttcggctacgtggtgacctgcatcctgtgcaagggcatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacagactgcacctgagcatctgcaagaagagaaagacctggagcaacgtgatgctggccgtgtgcaagagaatgtgcttcagagccaccgtggaggtgagcaacaaggccctgctgatcagaaacatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgtacctggacagcatcgtgaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctggaacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgatcatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8805 - RNA, 3495 nt, synthetic construct
  misc_feature 1..3495: note = derived and/or modified CDS sequence (opt4) from CCHVF(CCHVF BA66019)__AF350448.1__Gn-NSm-Gc
  source 1..3495: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccatcgtggaccagagactgggcagcgagctgggctgctacaccatcaacagagtgaagagcttcaagctgtgcgagaacagcggcaccggcaagagctgcaagatcgacaagcaccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcttctgcaagatcatcttctacctgctgatcgtggtgggcaccctgggcaagaagttcaagcagtacagagagctgaagccccagacctgcaccatctgcgagaccacccccaccaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgaggcctaccagaccagagagggctacaccagcgtgtgcctgttcatgctgggcggcatcctgttcgtggtgagctgcctgatgaagggcctggtggacagcgtgagcaacagcttcttccccggcctgagcatctgcaagacctgcagcatcggcagcgtgaacggcttcgagatcgagagccacaagtgctactgcagcctgctgtgctgcctgtactgcagacactgcagcgccgacagagagatccaccagctgcacctgagcatctgcaagaagagaagagccggcggcaacgtgatgctggccgtgtgcaagagaatgtgcctgagagccaccatggaggtgagcaacaaggtgctgttcatcagaagcatcatcaacaccaccttcgtgatctgcatcctggtgctggccgtgtgcatcgtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgacagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaacagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgccatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagatacctgaaggacgacgaggagagcggctacagaagaatcatcgagagactgaacaacaagaagggcaagaacaagctgctggacggcgagagactggccgacagaagaatcgccgagctgttcagcaccaagacccacatcggc

SEQ ID NO: 8806 - RNA, 3495 nt, synthetic construct
  misc_feature 1..3495: note = derived and/or modified CDS sequence (opt4) from CCHVF(CCHVF BA8402)__AF350449.1__Gn-NSm-Gc
  source 1..3495: mol_type = other RNA
agcgaggagagcggcgacgactgcatcagcagaacccagctgctgagaaccgagaccgccgagatccacaacgacaactacggcggccccggcgacaagatcaccatctgcaacggcagcaccgtggtggaccagagactgggcagcgagctgggctgctacaccatcaacagagtgaacagcttcaacctgtgcgagaacaccgccaccggcaagagctgcgagatcgacagcacccccgtgaagtgcagacagggcttctgcctgaagatcacccaggagggcagaggccacgtgaagctgagcagaggcagcgaggtggtgctggacgcctgcgagagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagacccaccagcgacggcctggccagacacgtgatgcagtgccccaagagaaaggagaagatcgaggagaccgccctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacagactgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctgcactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagagcaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8807 - RNA, 3495 nt, synthetic construct
  misc_feature 1..3495: note = derived and/or modified CDS sequence (opt4) from CCHVF(CCHVF Matin)__AF467769.2__Gn-NSm-Gc
  source 1..3495: mol_type = other RNA
agcgaggagagcggcgacgactgcatcagcagaacccagctgctgagaaccgagaccgccgagatccacagcgacagctacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggtgttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagatcagagagggctacaccagcgtgtgcctgttcgtgctgggcagcatcctgttcatcgtgagctgcctgatgaagggcctggtggacagcgacggcaacagcttcttccccggcctgagcatctgcaagacctgcagcatcggcagcatcaacggcttcgagatcgagagccacaagtgctactgcagcctgttctgctgcccctactgcagacactgcagcaccgacagagagatccacaagctgcacctgagcatctgcaagaagagaaagaccggcagcaacgtgatgctggccgtgtgcaagagaatgtgcttcagagccaccgtggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgatcaacttctgccaccaggagtgccaggtgaccgagaccgagtgcctgtgcccctacgaggccctggtgctgagaaagcccctgttcctggacagcatcatcaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggtgatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgagcatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcgccctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacgtgggc

SEQ ID NO: 8808 - RNA, 3495 nt, synthetic construct
  misc_feature 1..3495: note = derived and/or modified CDS sequence (opt4) from CCHVF(CCHVF Baghdad 12)__AJ538197.2__Gn-NSm-Gc
  source 1..3495: mol_type = other RNA
agcgaggagagcggcgacgactgcatcagcagaaccagactgctgagaaccgagaccgccgagatccacggcgacagctacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcaagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctggccgtgagcagcagccccgtgcagagcgcccccatcggctacggcaagaccatcgagacctaccaggccagagagggctacaccagcatctgcctgttcgtgctgggcagcatcctgttcatcgtgagctgcctgaccaagggcctggtggacagcatcggcaacatcttcttccccggcctgagcatctgcaagacctgcagcatcggcagcatcaacggcttcgaggtggagagccacaagtgctactgcagcctgctgtgctgcccctactgcagacactgcagcgccgacagagagatccaccagctgcacctgagcatctgcaagaagagaaagaccggcagcagcgtgatgctggccgtgtgcaagagaatgtgcttcagagccaccatggaggtgagcaacaaggccctgctgatcagaagcatcatcaacaccaccttcgtggtgtgcatcctgaccctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaccaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgacgccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggtgagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacttcttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8809 - RNA, 3495 nt, synthetic construct
  misc_feature 1..3495: note = derived and/or modified CDS sequence (opt4) from CCHVF(CCHVF VLG/TI29414)__AY179961.1__Gn-NSm-Gc
  source 1..3495: mol_type = other RNA
agcgaggagcccggcgacgactgcatcagcagaacccagctgctgagagccgagcccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggaacgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccaacctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctgggaggtgggcaccggctgcacctgctgcggctggaacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcatgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtgatcgccgccagcaccagcctgatggccagaaagctggagttcggcaccgacagcaccttcaaggccttcagcgccatgcccaagaccagcctgtgcttctacatcgccgagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8810 - RNA, 3495 nt, synthetic construct
  misc_feature 1..3495: note = derived and/or modified CDS sequence (opt4) from CCHVF(CCHVF TADJ/HU8966)__AY179962.1__Gn-NSm-Gc
  source 1..3495: mol_type = other RNA
agcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcagcgtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcaccagaatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagagagtggaggagaccgagctgtacctgaacctggagagaatcccctggatcgtgagaaagctgctgcaggtgagcgagagcaccggcgtggccctgaagagaagcagctggctgatcgtgctgctggtgctgttcaccgtgagcctgagccccgtgcagagcgcccccatcggctacggcaacaccatcgagacctaccaggccagagaggagtacaccagcatctgcctgttcgtgctgggcagcatcctgttcatcgtgagctgcctgatgaagggcctggtggacagcatcggcaacatcttcttccccggcctgaccatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcatcgtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaaccccctgaacagcaccagcctggagaccagcctgagcatcgaggccccctggggcgccatcaacgtgcagagcacctacaagcccaccgtgagcaccgccaacatcgccctgagctggagcagcatcgagcacagaggcaacaacatcctggtgagcggcagaagcgagagcatcatgaagctggaggagagaaccggcatcagcggcgacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcatcgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggagaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtacagaaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgagctgcttcaagtgctgcagaagaaccagaggcctgctgaagcacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8811 - RNA, 3495 nt, synthetic construct
  misc_feature 1..3495: note = derived and/or modified CDS sequence (opt4) from CCHVF(CCHVF Hodzha)__AY223476.1__Gn-NSm-Gc
  source 1..3495: mol_type = other RNA
agcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagagctgcgagatcgacagcacccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagaatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgttcgccgtgagcctgagccccgtgcagagcgcccccatcggccacggcaagaccatcgagacctaccaggccagagaggactacaccagcatctgcctgttcgtgctgggcagcatcctgttcatcgtgagctgcctgatgaagggcctggtggacagcatcggcaacatcttcttccccggcctgaccatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcaccaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagagaaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcaagtacaagcacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8812 - RNA, 3495 nt, synthetic construct
  misc_feature 1..3495: note = derived and/or modified CDS sequence (opt4) from CCHVF(CCHVF Kosovo/9553/2001)__AY675511.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatcgccagaatgagcaaccaccccaagaccaccatggccttcctgttctggttcagcctgggctacgtgatcacctgcatcctgtgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgaagcagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggccagcaccagcgccgtggagatggagaccctgcccgccgccacctgggagagagaggaggacctgaccaacttctgccaccaggagtgccaggtgcccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcaagagctgcagcgaggacgacaccaagaagtgcgtggacaccaagctggagcagccccagagcatcctgatcgagcacagaggcaccatcatcggcaagcccaacgacacctgccccgccaagaccagctgctggctggagagcgtgaagagcttcttctacggcctgaagaacatgctgggcagcgtgttcggcaacttcttcatcggcatcctgctgttcctggcccccttcttcctgtggatgctgagcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8813 - RNA, 3495 nt, synthetic construct
  misc_feature 1..3495: note = derived and/or modified CDS sequence (opt4) from CCHVF(CCHVF SPU41/84)__AY900142.1__Gn-NSm-Gc
  source 1..3495: mol_type = other RNA
agcgaggagagcagcgacgactgcatcagcagaacccagctgctgagaaccgagaccgccgagatccacggcgacaactacggcggccccggcgacaagatcaccatctgcaacggcagcaccgtggtggaccagagactgggcagcgagctgggctgctacaccatcaacagagtgaagaccttcaagctgtgcgagaacagcgccaccggcaagagctgcgagatcgacagcgtgcccgtgaagtgcagacagggctactgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcatctgcaaggtgatcttctacctgctgatcatcgtgggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcagccacggcaagaccgtggaggcctacagagccagagagggctacaccagcatgtgcctgttcgtgctgggcagcgtgctgttcctggtgagctgcctgatgaagggcctggtggacagcgtgggcaacaccttcttccccggcctgagcatctgcaagacctgcagcatcagcagcatcaacggcttcgagatcgagagccacagatgctactgcagcctgttctgctgcccctactgcagacactgcagcgccaacaaggagatccaccagctgcacctgagcatctgcaagaagagaaaggccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgcctgcgtggtgagcaccagcgccgtggagatggagagcctgcccgccggcacctgggagagagaggaggacctgaccaacttctgccaccaggagtgccaggtggccgacaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctggtgcacaagatcgagccccacttcaacaccagctggatgagctgggacggctgcgacctggactactactgcaacatgggcgactggcccagctgcacctacaccggcgtgacccagcacaaccacgccagcttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcaccagcctgacctgcaccggctgctacgcctgcagcagcggcatcagctgcaaggtgagaatccacgtggacgagcccgacgagctgaccgtgcacgtgaagagcgaggaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtgaacaccaagctggagcagccccagagcatcctgatcgagagaaagggcaccatcatcggcaagcagaacaacacctgcaaggccaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaagaatcgccgagctgttcagcaccaagacccacatcggc

SEQ ID NO: 8814 - RNA, 3495 nt, synthetic construct
  misc_feature 1..3495: note = derived and/or modified CDS sequence (opt4) from CCHVF(CCHVF UG3010)__AY900143.1__Gn-NSm-Gc
  source 1..3495: mol_type = other RNA
gccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcatcgtgtgcaaggtgctgttctacctgctgatcgtgatcggcaccctgagcaagaagctgaagcagtacagagagctgaagccccagacctgcatcgtgtgcgagagcacccccgtgaacgccatcgacgccgagatgcacgagctgaactgcaactacaacatctgcccctactgcgccagcagactgaccagcgacggcctggtgagacacgtgaaccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggccagggcaaggccgtggaggtgtacagagtgagagagagctacaccagcatctgcctgttcgtgctgggcagcgtgctgttcgccgtgagctggctgatcaagggcctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagatcacccacagaatgcacctgaacgtgtgcaagaagagaaaggccggcagcaacgtgatgctggccgtgtgcaagagaatgtgcttcaaggccaccgtggaggccagcaacaccgccctgctgatcagaggcatcatcaacagcaccttcgtgatctgcgtgctgatcctggtgatctgcgtggtgagcaccagcgccgtggacatggagaacctgcccgccggcatctgggagagagaggaggacctgaccaacttctgccaccaggagtgccaggtgaccgagaccgagtgcctgtgcccctacgaggccctgatcctgagaaagcccctgtacctggacagcatcgccaagggcatgaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccaggagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacatccagcagagactgcccagcgagatcgtgaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcagcgaccccgacgtggtggccgccggcagcagcctgatggccagaaagatcgagttcggcgccgacagcaccttcaaggccttcagcagcatgcccaagaacagcctgtgcttctacatcgtggagagagactactgcagcagctgcaccaacgacgacacccagaagtgcgtggacaccaagctggagcacccccagagcatcctgatcgagcacaagggcaccatcatcggcaagcagaacgacacctgcagcaccaagaccagctgctggctggagagcgtgaagagcttcttctacggcctgaagaacatgctgggcggcatcttcggcaacgtgttcctgggcatcttcctgttcctggcccccttcgccctgctgatcttcttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccgagctgttcagcaccaagacccacatcggc

SEQ ID NO: 8815 - RNA, 3495 nt, synthetic construct
  misc_feature 1..3495: note = derived and/or modified CDS sequence (opt4) from CCHVF(CCHVF Hy13)__AY900145.1__Gn-NSm-Gc
  source 1..3495: mol_type = other RNA
agcgaggagagcggcgacgactgcatcagcagaacccagctgagcagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccatcaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcagcagcatctgcaagacctgcagcatcggcagcatcaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggccaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8816 - RNA, 3495 nt, synthetic construct
  misc_feature 1..3495: note = derived and/or modified CDS sequence (opt4) from CCHVF(CCHVF Semunya)__DQ094832.1__Gn-NSm-Gc
  source 1..3495: mol_type = other RNA
gccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcgtggtgtgcaaggtgctgttctacctgctgatcgtgatcggcaccctgggcaagaagctgaagcagtacagagagctgaagccccagacctgcatcgtgtgcgagagcatccccgtgaacgccatcgacgccgagatgcacgagctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggccaggagaaggccatcgaggtgtaccaggtgagagagagctacaccagcatctgcctgttcgtgctgggcagcgtgctgttcgccgtgagctggctggtgaagggcctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagatcacccacagaatgcacctgaacatctgcaagagaagaaaggtgggcagcaacgtgatgctggccgtgtgcaagagaatgtgcttcaaggccaccgtggaggccagcaacagcgccctgctgatcagaagcatcatcaacagcaccttcgtgatctgcgtgctgatcctggtgatctgcgtggtgagcaccagcgccgtggacatggagaacctgcccgccggcatctgggagagagaggaggacctgaccaacttctgccaccaggagtgccaggtgaccgagaccgagtgcctgtgcccctacgaggccctgatcctgagaaagcccctgttcctggacagcatcgccaagggcaagaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacgtgcagcagagactgcccagcgagatcgtgaccctgcaccccaagatcgaggagggcttcttcgacctgatgcacgtgcagaaggtgctgttctgcaagtacagcctgcaggccaccagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcgtgaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagttcggcgccgacagcaccttcaaggccttcagcagcatgcccaagaacagcctgtgcttctacatcgtggagagagactactgcagcagctgcaccgacgacgacacccagaagtgcgtgaacatcaagctggagcacccccagagcatcctgatcgagcacaagggcaccatcatcggcaagcagaacgacacctgccccaccaagaccagctgctggctggagagcgtgaagagcttcttctacggcctgaagaacatgctgggcggcatcttcggcaacgtgttcctgggcatcttcctgttcctggcccccttcgccctgctgatcctgttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccaagctgttcagcaccaagacccacatcggc

SEQ ID NO: 8817 - RNA, 3495 nt, synthetic construct
  misc_feature 1..3495: note = derived and/or modified CDS sequence (opt4) from CCHVF(CCHVF SPU128/81/7)__DQ157174.1__Gn-NSm-Gc
  source 1..3495: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgagagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccacggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcgccgacaaggagatccacaagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatcggcatcttcctgttcctgggccccttcatcctgctgatcctgttcttcatgttcggctggagaatcctgttctgcttcaagtgctgcagaagaaccagaggcctgctgaagtacagacacctgaaggaggacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8818 - RNA, 3495 nt, synthetic construct
  misc_feature 1..3495: note = derived and/or modified CDS sequence (opt4) from CCHVF(CCHVF ROS/HUVLV-100)__DQ206448.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8819 - RNA, 3495 nt, synthetic construct
  misc_feature 1..3495: note = derived and/or modified CDS sequence (opt4) from CCHVF(CCHVF AP92)__DQ211625.1__Gn-NSm-Gc
  source 1..3495: mol_type = other RNA
agcgagggcggcgacggcggctgcatcagcagaacccagctgatcaagaccgagaccgccgaggtgcacggcgacgactacggcggccccggcgagaagatcaccatctgcaacggcagcaccatcgtggaccagagactgggcagcgagctgggctgctacaccatcaacagaatcaagagcttcaagctgtgcgagaacagcgcccagggcaagaactgcgagatcgacagcgcccccgtgcagtgcagacagggctactgcctgaagatcagccaggagggcagaggccacgtgaagctgagcagaggcagcgagatcgtgctggacgtgtgcgacaccagctgcgagatcatgatccccaagggcaccggcgacatcctggtggactgcagcggcggccagcagcacttcctgcagagcaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaagaccctgttctacatcctgatcatcatcggcaccctgggcaagaagctgaagcagtacagagagctgaagccccagacctgcaccatctgcgagagcgtgcccgtgaacgccatcgacgccgagatgcacgacctgaactgcagctacaacatctgcccctactgcgccagcagactgaccagcgagggcctgaccagacacgtgaaccagtgccccaagagaaaggagaaggtggaggagaccgagctgtacctgaacctggagagaatcccctggatcgtgagaaagctgctgcaggtgagcgagagcaccggcgtggccctgaagagaagcagctggatgatcgtgctgctgatcctgctgatcgtgagcatgagccccgtgcagagcgcccccatcagccaggagagaaccgtggccctgtaccagagcagagaggactacatgggcatctgcctggtgatcatgggcagcgtgctgctggccgtgagcctgctggtgagaggcctgatcgacagcatcagcagcaccttcttccccggcctgagcgtgtgcagaacctgccacatcggcagcatcaacggcttcgagatcgagagccacaagtgctactgcggcctgctgtgctgcccctactgcagagcctgcagcaccgaccaggacgcccaccagttccacctgagcgtgtgcaagaagagaaaggccggcagcaacgtgatgctggccgtgtgcaagagaatgtgcttcaaggccatcatcgaggccagcaacaaggtgctgttcatcagaaacgtgatcaacaccaccttcgtggtgtgcatcctggtgatggtggcctgcatcgccagcagcgccgccgtggagatggagaacctgcccgccggcacctgggagagagaggaggagctgaccaacttctgccaccaggagtgccaggtgaccgagaccgagtgcctgtgcccctacgagagcttcatcctgagaaagcccctgttcctggacagcatcgccaagggcgtgaagaacctgctgaacagcaccagcctggagaccagcctgagcatcgaggccccctggggcgccatcaacgcccagagcacctacaagcccaccgccagcagcgccaacatcgccctgacctggagcagcgtggagcacagaggcaacaagatcctggtgagcggcagaagcgagagcatcatgaagctggaggagagaaccggcatcagctggaacctgggcgtggaggacgccagcgagagcagaaccctgaccatcagcgtgatggacctgagccagatgtacagccccgtgttcgagtacctgagcggcgacagacaggtggaggagtggcccaaggccacctgcaccggcaactgccccgagagatgcggctgcaccagcagcacctgcctgtacaaggagtggccccacagcagaaactggagatgcaaccccacctggtgctggggcgtgggcaccggctgcacctgctgcggcctggacgtgaaggagctgttcaccgaccacatgctggtgaagtggaaggtggagtacatcaagaccgaggccatcgtgtgcgtggagctgaccagccaggagagacagtgcagcctgatcgaggccggcaccagattcagcctgggccccgtgaccatcaccctgagcgagcccagaaacatccagcagaagctgccccccgagctgatcaccctgcaccccaagatcgaggacggctacttcgacctgatgcacgtgcagaaggtgatgagcgccagcaccgtgtgcaagctgcagagctgcacccacggcgtgcccggcgacctgcagatctaccacgtgggcaacctgctgaagggcgacagagtgaacggccacctgatccacaaggtggagccccacctgaacaccagctggatgagctgggacggctgcgacctggactacttctgcaacatgggcgactggcccagctgcacctacaccggcgtgacccagcacaaccacgccgccttcgccaacctgctgaacatcgagaccgactacaccaagaccttccacttccacagcaagagagtgaccgcccacggcgacaccccccagctggacctgaaggccagacccagatacggcgccggcgagatcaccgtgctggtggaggtggccgacatggagctgcacaccaagaaggtggaggtgaccggcctgaagttcgccagcctgacctgcagcggctgctacgcctgcagcagcggcatcagctgcaaggtgagaatccacgtggacgagcccgacgagctgaccgtgcacgtgaagagcagcgaccccgacatcgtggccgccagcagcagcctgatggccagaaagatcgagttcggcgtggacagcaccttcaaggccttcagcagcatgcccaaggacagcctgtgcttctacatcgtggagagagactactgcaacagctgcaagaacgaggagacccagagatgcgtgaacgccaagctggagcagccccagagcatcctgatcgagcacaccggcaccatcatcggcaagcagaacgacacctgcggcagcagaaccagctgctggctggacagcttcaagagcttcttctacggcctgaagagcatgctgagcggcatcttcggcaacgtgttcctgggcatcttcctgttcctggcccccttcgccctgctgctgttcttcttcttcttcggctggagaatcctgttctgcttcaagtgctgcagaagaaccagaggcctgttcaagtacagacacatcaaggacgacgaggaggtgggctacaagaagatcatcgagagactgaacaacaagaagggcaagcacagactgctggacggcgagagactggccgacagaaagatcgccgagctgttcagcaccaagacccacatcggc

SEQ ID NO: 8820 - RNA, 3495 nt, synthetic construct
  misc_feature 1..3495: note = derived and/or modified CDS sequence (opt4) from CCHVF(CCHVF ArD8194)__DQ211626.1__Gn-NSm-Gc
  source 1..3495: mol_type = other RNA
gccgagggcggcagcaacgactgcgtgagcagaacccagctggtgaagaccgaggtggccgagatccacgaggacagctacggcggccccggcgagaagatcaccatctgcaacggcagcaccatcgtggaccagagactgggcagcgagctgggctgctacaccatcaacagagtgagaacctacaagctgtgcgagaacagcgccaccgagaagagctgcgagatcgacagcgtgcccgtgaagtgcaagcagggcttctgcctgaagatcacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacatccccctgctgggcagaaccgccatctacgtgtgcagaatgagcaaccaccccaagaccaccatggccttcctgttctggttcagcttcggctacgtgatcacctgcgtggtgtgcaaggtgctgttctacctgctgatcgtgatcggcaccctgggcaagagactgaagcagtacagagagctgaagccccagacctgcatcgtgtgcgagagcatccccgtgaacgccatcgacgccgagatgcacgacctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaaagctgctgcaggtgagcgagagcaccggcgtggccctgaagagaagctgctggatgatcaccctgctgatcctgctgaccgtgagcatgagccccgtgcagagcgcccccgtgggccacaagagagccgtggaggtgtaccagatgagagagagctacaccggcatctgcctgttcgtgctgggcagcgtgctgttcgccgtgagctggctggtgaaggccctgatcgacagcatcggcaacagcttcttccccggcctgagcatctgcaagacctgcagcatcggcagcatcaacggcttcgagatcgagagccacaagtgctactgcagcctgttctgctgcccctactgcagagcctgcagcagcgacaagatcacccacagaatgcacctgaacgtgtgcaagaagagaaaggtgggcagcaacgtgatgctggccgtgtgcaagagaatgtgcttcaaggccaccatcgaggccagcaacagagccaccttcatcagaaacatcatcaacagcaccttcgtgatctgcatcctgatcctggtgatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccctgatgctgagaaagcccctgttcctggacagaatcgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacaagggcaacaagatcctggtgagcggcagaagcgagagcatcatgaagctggaggagagaaccggcatcagctggtgcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgctggtgaagtggaaggtggagtacatcaagaccgaggccatcatctgcgtggagctgaccagccaggagagacagtgcagcctgatcgaggccggcaccagattcaacctgggccccgtgaccatcaccctgagcgagcccagaaacgtgcagcagagactgccccccgagatcatcaccctgcaccccaagatcgaggagggcttcttcgacctgatgcacgtgcagaaggtgatgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacctgaacaccagctggatgagctgggacggctgcgacctggactacttctgcaacatgggcgactggcccagctgcacctacaccggcgtgacccagcacaaccacgccgccttcatcaacatgctgaacatcgagaccgactacaccaagaccttccacttccacagcaagagagtgaccgcccacggcgacaccccccagctggacctgaaggccagacccgcctacggcgccggcgagatcaccgtgctggtggaggtggccgacctggagctgcacaccaagaagatcgaggtgagcggcctgaagttcgccagcctgagctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagagcggcgccgacagcaccttcaaggccttcagcagcatgcccaagaacagcctgtgcttctacatcgtggagagagactactgcagcagctgcaccgacgacgacacccagaagtgcgtggacatcaagctggagcacccccagagcatcctgatcgagcacaagggcaccatcatcggcaagcagaacgacacctgccccaccaagaccagctgctggctggagagcatcaagagcttcttctacggcctgaagaacatgctgagcggcatcttcggcaacgtgttcctgggcatgctgctgttcctggcccccttcatcctgctgatcctgttcttcttcttcggctggagactgctgttctgcctgaagtgctgcagaagaaccagaaagctgctgaagtacaagcacctgagagacgaggaggagagcggctacaagaagatcatcgagagactgaacgacaagaagggcaagagcagactgttcgacggcgagagactggccgacagaaagatcgccgagctgttcagcaccaagacccacatcggc

SEQ ID NO: 8821 - RNA, 3495 nt, synthetic construct
  misc_feature 1..3495: note = derived and/or modified CDS sequence (opt4) from CCHVF(CCHVF ArD15786)__DQ211627.1__Gn-NSm-Gc
  source 1..3495: mol_type = other RNA
gccgagggcggcagcaacgactgcgtgagcagaacccagctggtgaagaccgaggtgaccgagatccacgaggacagctacggcggccccggcgagaagatcaccatctgcaacggcagcaccatcgtggaccagagactgggcagcgagctgggctgctacaccatcaacagagtgagaacctacaagctgtgcgagaacagcgccaccgagaagagctgcgagatcgacagcgtgcccgtgaagtgcaagcagggcttctgcctgaagatcacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacatccccctgctgggccagaccgccatctacgtgtgcagaatgagcaaccaccccaagaccaccatggccttcctgttctggttcagcttcggctacgtgatcacctgcgtggtgtgcaaggtgctgttctacctgctgatcgtgatcggcaccctgggcaagagactgaagcagtacagagagctgaagccccagacctgcatcgtgtgcgagagcatccccgtgaacgccatcgacgccgagatgcacgacctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaaagctgctgcaggtgagcgagagcaccggcgtggccctgaagagaagctgctggatcatcaccctgctgatcctgctgaccgtgagcatgagccccgtgcagagcgcccccgtgggccacaagagagccgtggaggtgtaccagatcagagagagctacaccggcatctgcctgttcgtgctgggcggcgtgctgttcgccgtgagctggctggtgaaggccctgatcgacagcatcggcaacagcttcttccccggcctgagcatctgcaagacctgcagcatcggcagcatcaacggcttcgagatcgagagccacaagtgctactgcagcctgctgtgctgcccctactgcagagcctgcagcagcgacaagatcacccacagaatgcacctgaacgtgtgcaagaagagaaaggtgggcagcaacgtgatgctggccgtgtgcaagagaatgtgcttcaaggccaccatcgaggccaacaacagagccaccttcatcagaaacatcatcaacagcaccttcgtgatctgcatcctgatcctggtgatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccctgatgctgagaaagcccctgagcctggacagcatcgccaagggcatgaagagcctgctgaacagcaccagcctggagaccagcctgagcatcgaggccccctggggcgccatcaacgtgcagagcaccttcaagcccaccatcagcgccgccaacatcgccctgagctggagcagcgtggagcacaagggcaacaagatcctggtgagcggcagaagcgagagcatcatgaagctggaggagagaaccggcatcagctggtgcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgctggtgaagtggaaggtggagtacatcaagaccgaggccatcatctgcgtggagctgaccagccaggagagacagtgcagcctgatcgaggccggcaccagattcaacctgggccccgtgaccatcaccctgagcgagcccagaaacgtgcagcagagactgccccccgagatcatcaccctgcaccccaagatcgaggagggcttcttcgacctgatgcacgtgcagaaggtgatgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacctgaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagagcggcgccgacagcaccttcaaggccttcagcagcatgcccaagaacagcctgtgcttctacatcgtggagagagactactgcagcagctgcaccgacgacgacacccagaagtgcgtggacatcaagctggagcacccccagagcatcctgatcgagcacaagggcaccatcatcggcaagcagaacgacacctgccccaccaagaccagctgctggctggagagcatcaagagcttcttctacggcctgaagaacatgctgagcggcatcttcggcaacatcttcctgggcatgctgctgttcctggcccccttcgtgctgctgatcctgttcttcttcttcggctggagactgctgttctgcctgaagtgctgcagaagaaccagaaagctgctgaagtacaagcacctgagagacgaggaggagagcggctacaagaagatcatcgagagactgaacgacaagaagggcaagagcagactgttcgacggcgagagactggccgacagaaagatcgccgagctgttcagcaccaagacccacgtgggc

SEQ ID NO: 8822 - RNA, 3495 nt, synthetic construct
  misc_feature 1..3495: note = derived and/or modified CDS sequence (opt4) from CCHVF(CCHVF ArD39554)__DQ211628.1__Gn-NSm-Gc
  source 1..3495: mol_type = other RNA
agcgagagcaacaacaacgactgcgtgagcagaacccagctgatcaagaccgagaacgccgagatccacggcgacgactacggcggccccggcgagaagatcaccatctgcaacggcagcaccatcgtggagcagagactgggcagcgagctgggctgctacaccatcaacagaatcaagagcttcaagctgtgcgagaacagcgccagcggcaagggctgcgagatcgacagcacccccgtgaagtgcaagcagggcttctgcctgaagatcacccaggagggcagaggccacgtgaagctgagcagaggcagcgagatcatcctggacgtgtgcgacagcagctgcgagatgatgatccccaagggcagcggcgacatcctggtggactgcagcggcggccagcagcacttcctgcaggacaacctggtggacctgggctgccccaacgtgcccctgctgggcaagatggccatctacatctgcagaatgagcaaccaccccaagaccaccatggccttcctgttctggttcagcttcggctacgtgatcacctgcatcttctgcaaggtgatcttctacgtgctgatcatcatcggcaccctgggcaagagaatcaagcagtacagagagctgaagccccagacctgcaccatctgcgaggccacccccgtgaacgccatcgacgccgagatgcacgacctgaactgcagctacaacatctgcccctactgcgccagcagactgaccagcgagggcctggtgagacacgtgacccagtgccccaagagaaaggagaagatcgaggagaccgagctgtacctgaacctggagagaatcccctggttcgtgagaaagctgctgcaggtgagcgagagcaccggcgtggccctgaagagaagcagctggctggtgaccctgctggtgctgctgaccgtgagcctgagccccgtgcagagcgcccccatcggccaggagagaaccgtggtgacctaccaggtgagagagagctacaccggcatgtgcctgttcatcctgggcagcgtgctgttcgccatcagctggctgaccaagggcctggtggacagcgtgggcaacatcttcttccccggcctgagcgtgtgcaagacctgcagcatcggcagcatcaacggcttcgagatcgagagccacaagtgctactgcagcctgttctgctgcccctactgcagatactgcagcgccgacagaggcgcccaccagagccacctgagcgtgtgcaagaagagaaagaccggcagcaacgtgatgctggccgtgtgcaagagaatgtgcttcagagccaccctgaaggtgagcagcgaggccctgatcatcagaagcatcatcaacaccaccttcgtggtgtgcatcctgatcctggtggtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccttcgtgctgagaaagcccctgttcctggacagcaccgccaagagcatgaagagcctgctgaacagcaccagcctggagaccagcctgagcatcgaggccccctggggcgccatcaacgtgcagagcaccttcaagcccaccgccagcaccgccaacatcgccctgagctggagcagcgtggagcacagaggcaacaagatcctggtgaccggcagaagcgagagcatcatgaagctggaggagagaaccggcatcagctggaacctgggcgtggaggacgccagcgagagcaagaccctgaccgtgagcgtgatggacctgagccagatgtacagcaccgtgttcgagtacctgagcggcgacagacaggtggaggagtggcccaaggccacctgcaccggcgactgccccgagagatgcggctgcaccagcagcacctgcctgcacaaggcctggccccacagcagaaactggagatgcaaccccacctggtgctggggcgtgggcaccggctgcacctgctgcggcctggacgtgaagaacctgttcaccgactacatgctgatcaagtggaaggtggagttcatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagctggtgaccctgcaccccagagtggaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaagatcaacggcaacagcttccacaagatcgagcccaacctgaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgagaccccccagctggacctgaaggccagacccaagtacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgagactgcacgtggacgagcccgacgagctgaccgtgcacgtgaagagcgacgaccccgacgtggtggccgccagcagcagcctgatggccagaaagatcgagttcggcaccgacagcaccttcaaggccttcagcagcatgcccaaggacaagctgtgcttctacatcgtggagagagactactgcagcagctgcagcaaggaggacacccagaagtgcgtgaacgccaagctggagcagccccagagcatcctgatcgagcacaagggcaccatcatcggcaagcagaacgacacctgcaccgtgaaggccagctgctggctggagagcgtgaagagcttcttctacggcctgaagaacatgctgggcggcatcttcggcaacgtgatcctgggcatcatcatgttcctggcccccttcgccctgctgctgctgttcttcctgttcggctggagaatcctgttctgcctgagatgctgcagaagaaccagaggcctgttcaagtacaagcacatcaaggacgacgaggagagcggctacaagagaatcatcgagagactgaacaacaagaagggcaagaacaagctgttcgacggcgagagactggccgacaagaagatcgccgagctgttcagcaccaagacccacatcggc

SEQ ID NO: 8823 - RNA, 3495 nt, synthetic construct
  misc_feature 1..3495: note = derived and/or modified CDS sequence (opt4) from CCHVF(CCHVF C-68031)__DQ211629.1__Gn-NSm-Gc
  source 1..3495: mol_type = other RNA
agcgaggagagcggcgacgactgcatcagcagaacccagctgagcagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccatcaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcatcaacggcttcgagaccgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8824 - RNA, 3495 nt, synthetic construct
  misc_feature 1..3495: note = derived and/or modified CDS sequence (opt4) from CCHVF(CCHVF Drosdov)__DQ211630.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactacagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgatcctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatgaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcaactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggtgtgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcatcttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8825 - RNA, 3495 nt, synthetic construct
  misc_feature 1..3495: note = derived and/or modified CDS sequence (opt4) from CCHVF(CCHVF Kashmanov)__DQ211631.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcaccatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacagcctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8826 - RNA, 3495 nt, synthetic construct
  misc_feature 1..3495: note = derived and/or modified CDS sequence (opt4) from CCHVF(CCHVF Oman)__DQ211632.1__Gn-NSm-Gc
  source 1..3495: mol_type = other RNA
agcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacaccagcatctgcctgttcgtgctgggcagcatcctgttcatcgtgagccacctgatgaagggcctggtggacagcgtgggcaacagcttcttccccggcctgagcatctgcaagacctgcagcatcggcagcatcaacggcttcgagatcgagagccacaagtgcttctgcagcctgttctgctgcccctactgcagacactgcagcgccgacaaggagatccacaagctgcacctgagcatctgcaagaagagaaaggccggcagcaacgtgatgctggccgtgtgcaagagaatgtgcttcagagccaccatggaggtgagcaacaaggccctgctgatcagaagcgtgatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8827 - RNA, 3495 nt, synthetic construct
  misc_feature 1..3495: note = derived and/or modified CDS sequence (opt4) from CCHVF(CCHVF SPU97/85)__DQ211633.1__Gn-NSm-Gc
  source 1..3495: mol_type = other RNA
agcgaggagagcgacggcgactgcatcagcagaacccagctgctgagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcagaatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggccacggcaagaccatcgagacctaccaggccagagagggctacaccagcttctgcctgttcatcctgggcagcatcctgttcatcgtgagctgcctggtgaagggcctgatcgacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccatcgaggtgagcaacagagccctgctgatcagaagcatcatcaacaccaccttcgccgtgtgcatcctgaccctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacacccagaagtgcgtgaacaccaagctggagagaccccagagcatcctgatcgagcacaagggcaccatcatcggcaagcagaacgacacctgcaccgccaaggccagctgctggctggagagcgtgaagagcttcttctacggcctgaagagcatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggc

SEQ ID NO: 8828 - RNA, 3495 nt, synthetic construct
  misc_feature 1..3495: note = derived and/or modified CDS sequence (opt4) from CCHVF(CCHVF SPU103/87)__DQ211634.1__Gn-NSm-Gc
  source 1..3495: mol_type = other RNA
agcgaggagagcagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagaccttcaagctgtgcgagaacagcgccaccggcaagagctgcgagatcgacagcgtgcccgtgaagtgcagacagggctactgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcgtgctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaagactgctgcaggtgagcgagagcaccggcgtggccctgaagagaagcagctggctgatcgtgctgctggtgctgttcaccgtgagcctgagccccgtgcagagcgcccccatcagccacggcaagaccgtggaggcctaccaggccagagagggctacaccggcatgtgcctgttcgtgctgggcagcatcctgttcctggtgagctgcctgatgaagggcctggtggacagcgtgggcaacaccttcttccccggcctgagcatctgcaagacctgcagcatcagcagcatcaacggcttcgagatcgagagccacagatgctactgcagcctgttctgctgcccctactgcagacactgcagcgccaacaaggagatccaccagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagagcctgcccgccggcacctgggagagagaggaggacctgaccaacttctgccaccaggagtgccaggtgaccgacaccgagtgcctgtgcccctacgaggccctggtgctgagaagacccctgttcctggacaacatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaagatcgagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgcccagcgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctggtgcacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcaccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtgaacaccaagctggagcagccccagagcatcctgatcgagcacaagggcaccatcatcggcaagcagaacaacacctgcaaggccagagccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaagaatcgccgagctgttcagcaccaagacccacatcggc

SEQ ID NO: 8829 - RNA, 3495 nt, synthetic construct
  misc_feature 1..3495: note = derived and/or modified CDS sequence (opt4) from CCHVF(CCHVF SPU415/85)__DQ211635.1__Gn-NSm-Gc
  source 1..3495: mol_type = other RNA
agcgaggagagcgacggcgactgcatcagcagaacccagctgctgagaaccgagaccaccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcaactgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccatccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggccacggcaagaccatcgagacctaccaggccagagagggctacaccagcttctgcctgttcatcctgggcagcatcctgttcgtggtgagctgcctggtgaagggcctgatcgacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccatcgaggtgagcaacagagccctgctgatcagaaacatcatcaacaccaccttcgtggtgtgcatcctgaccctggccgtgtgcgtggtgagcaccagcgccgtggagatggagagcctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagagagtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgaagatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacaccagaaagtgcgtgaacaccaagctggacagaccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggc

SEQ ID NO: 8830 - RNA, 3495 nt, synthetic construct
  misc_feature 1..3495: note = derived and/or modified CDS sequence (opt4) from CCHVF(CCHVF Turkey200310849)__DQ211636.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcagctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagatctaccagaccagagagggcttcgccagcatctgcctgttcatgctgggcagcatcctgttcatcgtgagctgcctggtgaagggcctggtggacagcgtgagcgacagcttcttccccggcctgagcgtgtgcaagacctgcagcatcggcagcgtgaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccgccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggc

SEQ ID NO: 8831 - RNA, 3495 nt, synthetic construct
  misc_feature 1..3495: note = derived and/or modified CDS sequence (opt4) from CCHVF(CCHVF Iran-52)__DQ446215.1__Gn-NSm-Gc
  source 1..3495: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggccacggcaagaccatcgagacctacagagtgagagaggagtacaccagcatctgcctgttcgtgctgggcagcatcctgttcatcgtgagcttcctgatgaagggcctggtggacggcgtgggcaacatcttcttccccggcctgagcgtgtgcaagacctgcagcatcggcagcatcaacggcttcgagatcgagagccacaagtgctactgcagcctgttctgctgcccctactgcagacactgcagcgccgacggcgagatccaccagctgcacctgagcatctgcaagaagagaaagaccggcagcaacgtgatgctggccgtgtgcaagagaatgtgcttcagagccaccatggaggtgagcaacaaggccctgttcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggaggagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8832 - RNA, 3495 nt, synthetic construct
  misc_feature 1..3495: note = derived and/or modified CDS sequence (opt4) from CCHVF(CCHVF Iran-53)__DQ446216.1__Gn-NSm-Gc
  source 1..3495: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggccacggcaagaccatcgagacctacagagtgagagaggagtacaccagcatctgcctgttcgtgctgggcagcatcctgttcatcgtgagcttcctgatgaagggcctggtggacggcgtgggcaacatcttcttccccggcctgagcgtgtgcaagacctgcagcatcggcagcatcaacggcttcgagatcgagagccacaagtgctactgcagcctgttctgctgcccctactgcagacactgcagcgccgacggcgagatccaccagctgcacctgagcatctgcaagaagagaaagaccggcagcaacgtgatgctggccgtgtgcaagagaatgtgcttcagagccaccatggaggtgagcaacaaggccctgttcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8833 - RNA, 3495 nt, synthetic construct
  misc_feature 1..3495: note = derived and/or modified CDS sequence (opt4) from CCHVF(CCHVF Kosova Hoti)__EU037902.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccagaagggcagaggccacgtgaagctgagcagaggcagcgaggtggtgctggacgcctgcgacagcaactgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccaagaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgaagcagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgaacatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgcccccagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccggcaccagcctgatggccagaaagctggagttcggcaccgacagcaccttcaaggccttcagcgccatgcccaagaccagcctgtgcttctacatcgtggagaaggagtactgcaagagctgcagcgaggacgacaccaagaagtgcgtggacaccaagctggagcagccccagagcatcctgatcgagcacagaggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8834 - RNA, 3495 nt, synthetic construct
  misc_feature 1..3495: note = derived and/or modified CDS sequence (opt4) from CCHVF(CCHVF YL04057)__FJ562094.1__Gn-NSm-Gc
  source 1..3495: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagagactgggcagagagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggcaaggagagagccatcgagacctaccaggccagagagacctacaccggcatctgcctgttcgtgctgggcagcgtgctgttcgccgtgagctggctgaccaaggccctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagaacacccacagaatgcacctgaacgtgtgcaagaagagaaagatgggcagcaacgtgatgctggccgtgtgcaagagaatgtgcttcagagccaccatcgaggccagcaacaaggccctgctgatcagaagcatcatcaacagcaccttcgtgatctgcatcctgatcctgaccatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccatggtgctgagaaagcccctgttcctggacagcatcgccaagggcaagaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcagccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccaggtgtaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcctgctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggc

SEQ ID NO: 8835 - RNA, 3495 nt, synthetic construct
  misc_feature 1..3495: note = derived and/or modified CDS sequence (opt4) from CCHVF(CCHVF V42/81)__GU477490.1__Gn-NSm-Gc
  source 1..3495: mol_type = other RNA
agcaaggagcccggcgacgactgcatcagcagaacccagctgatgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaaggcctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctggagtgcccccacatccccctgctgggcaagctggccatctacatctgcagaatgagcaaccaccccagaaccaccatggccttcctgttctggttcggcttcggctacgtgatcacctgcatcctgtgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggtgctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcatcgtgaagggcctggtggacagcgtgagcgacagcttcttccccggcctgagcgtgtgcaagacctgcagcatcagcagcatcaacggcttcgagatcgagagccacaagtgctactgcagcctgttctgctgcccctactgcagacactgcagcgccgacagagagatccaccagctgcacctgagcatctgcagaaagagaagaaccggcagcaacgtgatgctggccgtgtgcaagagaatgtgcttcagagccaccatcgaggtgagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacatccagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcatcgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgagaccccccagctggacctgaaggccagacccgcctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagagcggcaccgacagcaccttcaaggccttcagcgccatgcccaagaccagcctgtgcttctacatcgtggagagagagtactgcaagagctgcagcgaggacgacacccagaagtgcgtggagaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggaggacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8836 - RNA, 3495 nt, synthetic construct
  misc_feature 1..3495: note = derived and/or modified CDS sequence (opt4) from CCHVF(CCHVF 79121M18)__GU477493.1__Gn-NSm-Gc
  source 1..3495: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagggcctgggcagcgagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggcaaggagagagccatcgagacctaccaggccagagagacctacaccggcatctgcctgttcgtgctgggcagcgtgctgttcgccgtgagctggctgaccaaggccctgatcgacggcatcggcaacagcttcagccccggcctgagcgtgtgcaagacctgcagcatcggcagcatcaacggcttcgagatcgagagccacaagtgctactgcagcctgttctgctgcccctactgcagagcctgcagcagcgacaagaacacccacagaatgcacctgaacgtgtgcaagaagagaaagatgggcagcaacgtgatgctggccgtgtgcaagagaatgtgcttcagagccaccatcgaggccagcaacaaggccctgctgatcagaagcatcatcaacagcaccttcgtgatctgcatcctgatcctgaccatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccatggtgctgagaaagcccctgttcctggacagcaccgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccagatctaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcttcctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggc

SEQ ID NO: 8837 - RNA, 3495 nt, synthetic construct
  misc_feature 1..3495: note = derived and/or modified CDS sequence (opt4) from CCHVF(CCHVF Afg09-2990)__HM452306.1__Gn-NSm-Gc
  source 1..3495: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcactacctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggccacggcaagaccatcgagacctacagagtgagagaggagtacaccagcatctgcctgttcgtgctgggcagcatcctgttcatcgtgagcttcctgatgaagggcctggtggacggcgtgggcaacatcttcttccccggcctgagcgtgtgcaagacctgcagcatcggcagcatcaacggcttcgagatcgagagccacaagtgctactgcagcctgttctgctgcccctactgcagacactgcagcgccgacggcgagatccaccagctgcacctgagcatctgcaagaagagaaagaccggcagcaacgtgatgctggccgtgtgcaagagaatgtgcttcagagccaccatggaggtgagcaacaaggccctgttcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8838 - RNA, 3495 nt, synthetic construct
  misc_feature 1..3495: note = derived and/or modified CDS sequence (opt4) from CCHVF(CCHVF Sudan Al-Fulah 3-2008)__HQ378184.1__Gn-NSm-Gc
  source 1..3495: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgtgatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcagacagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccacggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcgccgacaaggagatccacaagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagaaggagtactgcaagagctgcagcgaggaggacaccaagaagtgcgtgaacaccaagctggagcagccccagagcatcctgatcgagcacaagggcaccatcatcggcaagcagaacagcacctgcaccgccaaggtgagctgctggctggagagcgccaagagcttcttctacggcctgaaggacatgctgagcggcatcttcggcaacgtgttcatcggcatcttcctgttcctggcccccttcgtgctgctggtgctgttcttcatgttcggctggagaatcctgctgtgcttcagatgctgcagaagaaccagaggcctgttcaagtacagacacctgaaggacgacgaggagaccggctacagaagaatcatcgagagactgaacaacaagaagggcaagaacaagctgctggacggcgagagactggccgacagaaagatcgccgagctgttcagcaccaagacccacatcggc

SEQ ID NO: 8839 - RNA, 3495 nt, synthetic construct
  misc_feature 1..3495: note = derived and/or modified CDS sequence (opt4) from CCHVF(CCHVF Sudan AB1-2009)__HQ378187.1__Gn-NSm-Gc
  source 1..3495: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacctgatcacctgcatcctgtgcaaggccatcttctacctgctgatcatcatcggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcaacgaggaggacaccaagaagtgcgtgaacaccaagctggagcagccccagagcatcctgatcgagcacaagggcaccatcatcggcaagcagaacagcacctgcaccgccagagccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8840 - RNA, 3495 nt, synthetic construct
  misc_feature 1..3495: note = derived and/or modified CDS sequence (opt4) from CCHVF(CCHVF NIVA 118595)__JN572083.1__Gn-NSm-Gc
  source 1..3495: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcatcgccctgaagagaagcagctggctgatcgtgctgctggtgctgttcaccgtgagcatcacccccgtgcagagcgcccccatcggccacggcaagaccatcgaggcctacagagccagagaggagtacaccagcatctgcctgttcgtgctgggcagcgtgctgttcgtggtgagctgcctgatgaagggcctggtggacagcgtgggcaacatcttcttccccggcctgttcatctgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagaaccaccatggaggtgagcaacaaggccctgttcgtgagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagagcggcaccgacagcaccttcaaggccttcagcgccatgcccaagaccagcctgtgcttctacatcgtggagagagagtactgcaagggctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcctgggcatcttcagcttcctggcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8841 - RNA, 3495 nt, synthetic construct
  misc_feature 1..3495: note = derived and/or modified CDS sequence (opt4) from CCHVF(CCHVF NIV 112143)__JN572085.1__Gn-NSm-Gc
  source 1..3495: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcatcgccctgaagagaagcagctggctgatcgtgctgctggtgctgttcaccgtgagcatcacccccgtgcagagcgcccccatcggccacggcaagaccatcgaggcctacagagccagagaggagtacaccagcatctgcctgttcgtgctgggcagcgtgctgttcgtggtgagctgcctgatgaagggcctggtggacagcgtgggcaacatcttcttccccggcctgttcatctgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgttcgtgagaagcatcatcaacaccaccttcgtggtgtgcatcctgatcctggccatctgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagggctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcctgggcatcttcagcttcctggcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8842 - RNA, 3495 nt, synthetic construct
  misc_feature 1..3495: note = derived and/or modified CDS sequence (opt4) from CCHVF(CCHVF SCT ex Afghanistan)__KC344856.1__Gn-NSm-Gc
  source 1..3495: mol_type = other RNA
agcgaggagagcggcgacgactgcatcagcagaacccagctgctgagaaccgagaccgccgaggtgcacaacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcaagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcttctgcaaggtgatcttctacctgctgatcgtggtgggcaccctgggcaagaagttcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacatcagcgtgtgcctgttcgtgctgggcggcatcctgttcgtggtgagctgcctgatcaagggcctggtggacagcgtgggcaacagcttcttccccggcctgagcatctgcaagacctgcagcatcggcagcgtgaacggcttcgagatcgagagccacaagtgctactgcagcctgctgtgctgcccctactgcagacactgcagcaccgacagagagatccaccagctgcacctgagcatctgcaagaagagaagaaccggcggcaacgtgatgctggccgtgtgcaagagaatgtgcttcagagccaccatggaggtgagcaacaaggtgctgttcatcagaaacatcatcaacaccaccttcgtgatctgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctgaacagcatcgtgaagggcatgaagaacctgctgaacagcaccaacctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagagcctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaagctgaacggccacatgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgacatcagcggcctgaagttcgccagcctgacctgcgccggctgctacgcctgcagcagcggcatcagctgcaaggtgagaatccacgtggacgagcccgacgagctgaccgtgcacgtgaagagcgaggaccccgacatcgtggccgccagcaccagcctgatcgccagaaagctggagctgggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagggcatcctgatcgagcacaagggcaccatcatcggcaagcagaacgacacctgcaccgccaaggccggctgctggctggagagcgtgaagagcttcttctacggcctgaagaacatgctgagcggcatcttcggcaacgtgttcatcggcatcttcctgttcctggcccccttcgtgctgctgatcctgttcttcatgttcggctggagactgctgttctgcttcaagtgctgcagaagaaccagaggcctgttcaagtacagacacctgaaggaggacgaggagagcggctacagaagaatcatcgagagactgaacaacaagaagggcaagaacaagctgctggacggcgagagactggccgacagaagaatcgccgagctgttcagcaccaagacccacatcggc

SEQ ID NO: 8843 - RNA, 3495 nt, synthetic construct
  misc_feature 1..3495: note = derived and/or modified CDS sequence (opt4) from CCHVF(CCHVF Zahedan 2007)__KC867273.1__Gn-NSm-Gc
  source 1..3495: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggcttctgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggccacggcaagaccatcgagacctacagagtgagagaggagtacaccagcatctgcctgttcgtgctgggcagcatcctgttcatcgtgagcttcctgatgaagggcctggtggacggcgtgggcaacatcttcttccccggcctgagcgtgtgcaagacctgcagcatcggcagcatcaacggcttcgagatcgagagccacagatgctactgcagcctgttctgctgcccctactgcagacactgcagcgccgacggcgagatccaccagctgcacctgagcatctgcaagaagagaaagaccggcagcaacgtgatgctggccgtgtgcaagagaatgtgcttcagagccaccatggaggtgagcaacaaggtgctgttcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaaggacatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcttcttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8844 - RNA, 3495 nt, synthetic construct
  misc_feature 1..3495: note = derived and/or modified CDS sequence (opt4) from CCHVF(CCHVF SPU 44/08)__KJ682805.1__Gn-NSm-Gc
  source 1..3495: mol_type = other RNA
agcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagccacggcgagaccgtggaggtgtaccagaccagagagggctacaccagcatctgcctgttcgtgctgggcagcatcctgttcctggtgagctgcctgatgagaggcctggtggacagcgtgagcaacagcttcttccccggcctgagcatctgcaagacctgcagcatcggcagcatcaacggcttcgagatcgagagccacaagtgctactgcagcctgttctgctgcccctactgcagacactgcagcgccgacatcgagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcatcaagagcttcttctacggcctgaagaacatgctgagcggcatcttcggcaacgtgttcatcggcatcttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggc

SEQ ID NO: 8845 - RNA, 3495 nt, synthetic construct
  misc_feature 1..3495: note = derived and/or modified CDS sequence (opt4) from CCHVF(CCHVF SPU 383/87)__KJ682806.1__Gn-NSm-Gc
  source 1..3495: mol_type = other RNA
agcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctggtggtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatccagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagccacggcgagaccgtggaggtgtaccagaccagagagggctacaccagcatctgcctgttcgtgctgggcagcatcctgttcctggtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacatcgagatccacagactgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcttcggcaagcagaacgacacctgcaccgccaaggccagctgctggctggagagcgtgaagagcttcttctacggcctgaagaacatgctgagcggcatcttcggcaacgtgttcatcggcgtgttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggc

SEQ ID NO: 8846 - RNA, 3495 nt, synthetic construct
  misc_feature 1..3495: note = derived and/or modified CDS sequence (opt4) from CCHVF(CCHVF SPU 130/89)__KJ682807.1__Gn-NSm-Gc
  source 1..3495: mol_type = other RNA
agcgaggagcccaactacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcagccacggcgagaccgtggaggtgtaccagaccagagagggctacaccagcatctgcctgttcgtgctgggcagcatcctgttcctggtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacatcgagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgagcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagcactgcaagagctgcagcaaggaggacacccagagatgcgtgaacaccaagctggagcagccccagagcatcctgatcgagcacaagggcaccatcatcggcaagcagaacgacacctgcaccgccaaggccagctgctggctggagagcatcaagagcttcttctacggcctgaagaacatgctgagcggcatcttcggcaacgtgttcatcggcgtgttcctgttcctggcccccttcatcatcctgatcctgttcttcatgttcggctggagaatcctgttctgcttcaagtgctgcagaagaaccagaggcctgctgaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggc

SEQ ID NO: 8847 - RNA, 3495 nt, synthetic construct
  misc_feature 1..3495: note = derived and/or modified CDS sequence (opt4) from CCHVF(CCHVF SPU 497/88)__KJ682808.1__Gn-NSm-Gc
  source 1..3495: mol_type = other RNA
agcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcaagggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggtgttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagccacggcgagaccgtggaggtgtaccagaccagagagggctacaccagcatctgcctgttcgtgctgggcggcatcctgttcctggtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacatcgagatccacaagctgcacctgagcatctgcaagaagagaaagacctggagcaacgtgatgctggccgtgtgcaagagaatgtgcttcagagccaccgtggaggtgagcaacaaggccctgctgatcagaaacatcatcaacaccaccttcgtggtgtgcatcctgatcctggccatctgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgagaaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccagagccagctgctggctggagagcatcaagagcttcttctacggcctgaagaacatgctgagcggcatcttcggcaacgtgttcatcggcatcttcctgttcttcgcccccttcatcatgctgatcctgttcttcatgttcggctggagaatcctgttctgcttcaagtgctgcagaagaaccagaggcctgttcaagtacagacacctgaaggacgacgaggaggtgggctacagaaagatcatcgagagactgaacaacaagaagggcaagaacaagctgctggacggcgagagactggccgacagaaagatcgccgagctgttcagcaccaagacccacatcggc

SEQ ID NO: 8848 - RNA, 3495 nt, synthetic construct
  misc_feature 1..3495: note = derived and/or modified CDS sequence (opt4) from CCHVF(CCHVF SPU 18/88)__KJ682810.1__Gn-NSm-Gc
  source 1..3495: mol_type = other RNA
agcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatgggcttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagccacggcgagaccgtggaggtgtaccagaccagagagggctacaccagcatctgcctgttcgtgctgggcagcatcctgttcctggtgagctgcctgatgaagggcctggtggacagcgtgggcaacagcttcagccccggcctgagcatctgcaagacctgcagcatcggcagcatcaacggcttcgagatcgagagccacaagtgctactgcagcctgttctgctgcccctactgcagacactgcagcgccgacatcgagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagaacctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccggcaaggccggctgctggctggagagcatcaagagcttcttctacggcctgaagaacatgctgagcggcatcttcggcaacgtgttcatcggcatcttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaagaacaagaagggcaagaacaagctgctggacggcgagagactggccgacagaaagatcgccgagctgttcagcaccaagacccacatcggc

SEQ ID NO: 8849 - RNA, 3495 nt, synthetic construct
  misc_feature 1..3495: note = derived and/or modified CDS sequence (opt4) from CCHVF(CCHVF SPU 556/87)__KJ682811.1__Gn-NSm-Gc
  source 1..3495: mol_type = other RNA
agcgaggagagcgacggcgactgcatcagcagaacccagctgctgagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcagaatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggccacggcaagaccatcgagacctaccaggccagagagggctacaccagcttctgcctgttcatcctgggcagcatcctgttcatcgtgagctgcctggtgaagggcctgatcgacagcgtgggcaacagcttcttccccggcctgagcatctgcaagacctgcagcatcggcagcgtgaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgagcgccgtgtgcaagagaatgtgcttcagagccaccatcgaggtgagcaacagagccctgctgatcagaagcatcatcaacaccaccttcgccgtgtgcatcctgaccctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacacccagaagtgcgtgaacaccaagctggagagaccccagagcatcctgatcgagcacaagggcaccatcatcggcaagcagaacgacacctgcaccgccaaggccagctgctggctggagagcgtgaagagcttcttctacggcctgaagagcatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggc

SEQ ID NO: 8850 - RNA, 3495 nt, synthetic construct
  misc_feature 1..3495: note = derived and/or modified CDS sequence (opt4) from CCHVF(CCHVF SPU 431/85)__KJ682812.1__Gn-NSm-Gc
  source 1..3495: mol_type = other RNA
agcgaggagagcgacggcgactgcatcagcagaacccagctgctgagaaccgagaccaccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcaactgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccatccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggccacggcaagaccatcgagacctaccaggccagagagggctacaccagcttctgcctgttcatcctgggcagcatcctgttcgtggtgagctgcctggtgaagggcctgatcgacagcgtgggcaacagcttcttccccggcctgagcatctgcaagacctgcagcatcggcagcatcaacggcttcgagatcgagagccacaagtgctactgcagcctgttctgctgcccctactgcagacactgccccgccgacagagagatccacaagctgcacctgagcatctgcaagaagagaaagaccggcagcaacgtgatgctggccgtgtgcaagagaatgtgcttcagagccaccatcgaggtgagcaacagagccctgctgatcagaaacatcatcaacaccaccttcgtggtgtgcatcctgaccctggccgtgtgcgtggtgagcaccagcgccgtggagatggagagcctgcccgccggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcagaaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagagagtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgaagatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacaccagaaagtgcgtgaacaccaagctggacagaccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggc

SEQ ID NO: 8851 - RNA, 3495 nt, synthetic construct
  misc_feature 1..3495: note = derived and/or modified CDS sequence (opt4) from CCHVF(CCHVF SPU 48/90)__KJ682813.1__Gn-NSm-Gc
  source 1..3495: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgtgatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaccaccaccatggccttcctgttctggttcagcttcggctacgtgatcacctgcatcctgtgcaaggccatcttctacctgctgatcatcatcggcaccctgggcaagagattcagacagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccacggcaagaccatcgaggcctacagagccagagagggctacaccagcatctgcctgttcgtgctgggcagcatcctgttcgtggtgagctgcctgatgaagagactggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcgccgacaaggagatccacaagctgcacctgagcatctgcaagaagagaaagaccggcagcaacgtgatgctggccgtgtgcaagagaatgtgcttcagagccaccatggaggtgagcgacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcagagacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaacagagccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagaaggagtactgcaagagctgcagcgaggaggacaccaagaagtgcgtgaacaccaagctggagcagccccagagcatcctgatcgagcacaagggcaccatcatcggcaagcagaacagcacctgcaccgccaaggtgagctgctggctggagagcgccaagagcttcttctacggcctgaaggacatgctgagcggcatcttcggcaacgtgttcatcggcatcttcctgttcctggcccccttcatcctgctgatcctgttcttcatgttcggctggagaatcctgctgtgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8852 - RNA, 3495 nt, synthetic construct
  misc_feature 1..3495: note = derived and/or modified CDS sequence (opt4) from CCHVF(CCHVF SPU 187/90)__KJ682814.1__Gn-NSm-Gc
  source 1..3495: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccacggcaagaccatcgaggcctacagagccagagagggctacaccagcatctgcctgttcgtgctgggcagcatcctgttcgtggtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacaaggagatccacaagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcatcttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaagaccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8853 - RNA, 3495 nt, synthetic construct
  misc_feature 1..3495: note = derived and/or modified CDS sequence (opt4) from CCHVF(CCHVF Haskovo-V46/13)__KR092379.1__Gn-NSm-Gc
  source 1..3495: mol_type = other RNA
agcgaggagctgggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagaggcaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgcccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgggcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgccatgtgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccggcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccaagctggagcagccccagagcatcctgatcgagcacaagggcaccatcatcggcaagcagaacgacacctgcaccgccagagccagctgctggctggagagcgtgaagagcttcttctacggcctgaagaacatgctgggcagcgtgttcggcaacttcctgatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8854 - RNA, 3495 nt, synthetic construct
  misc_feature 1..3495: note = derived and/or modified CDS sequence (opt4) from CCHVF(CCHVF 24-R-2012)__KR814856.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcgtgtgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8855 - RNA, 3495 nt, synthetic construct
  misc_feature 1..3495: note = derived and/or modified CDS sequence (opt4) from CCHVF(CCHVF 36-ST-2014)__KR814857.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgagcgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggaccagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgtgcggctggaagttcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagagccacatcggc

SEQ ID NO: 8856 - RNA, 3495 nt, synthetic construct
  misc_feature 1..3495: note = derived and/or modified CDS sequence (opt4) from CCHVF(CCHVF 37-R-2013)__KR814858.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcgtgtgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggacgacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgtgacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8857 - RNA, 3495 nt, synthetic construct
  misc_feature 1..3495: note = derived and/or modified CDS sequence (opt4) from CCHVF(CCHVF 44-ST-2010)__KR814859.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgctgtggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcttcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgagcgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggaccagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgtgcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagagccacatcggc

SEQ ID NO: 8858 - RNA, 3495 nt, synthetic construct
  misc_feature 1..3495: note = derived and/or modified CDS sequence (opt4) from CCHVF(CCHVF 46-ST-2012)__KR814860.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacgccaccttcgtgatctgcatcctgaccctgaccatctgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8859 - RNA, 3495 nt, synthetic construct
  misc_feature 1..3495: note = derived and/or modified CDS sequence (opt4) from CCHVF(CCHVF 47-ST-2013)__KR814861.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcagaacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgttcatcagaagcatcatcaacaccaccttcgtgacctgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgagtgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8860 - RNA, 3495 nt, synthetic construct
  misc_feature 1..3495: note = derived and/or modified CDS sequence (opt4) from CCHVF(CCHVF 52-R-2014)__KR814862.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacgtgcccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcgtgtgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagatgggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggacgacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccggctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8861 - RNA, 3495 nt, synthetic construct
  misc_feature 1..3495: note = derived and/or modified CDS sequence (opt4) from CCHVF(CCHVF 75-R-2012)__KR814863.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcgcccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtgaacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcctgtacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8862 - RNA, 3495 nt, synthetic construct
  misc_feature 1..3495: note = derived and/or modified CDS sequence (opt4) from CCHVF(CCHVF 75-ST-2010)__KR814864.1__Gn-NSm-Gc
  source 1..3495: mol_type = other RNA
agcgaggagagcggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcctgttctgcaaggccctgttctacagcctgatcatcatcggcaccctgggcaagaagatcaagcagtacagagagctgagaccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagagccagaggcctgctgaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8863 - RNA, 3495 nt, synthetic construct
  misc_feature 1..3495: note = derived and/or modified CDS sequence (opt4) from CCHVF(CCHVF 81-R-2014)__KR814865.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8864 - RNA, 3495 nt, synthetic construct
  misc_feature 1..3495: note = derived and/or modified CDS sequence (opt4) from CCHVF(CCHVF 3756-ST-2007)__KR814866.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctgacccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8865 - RNA, 3495 nt, synthetic construct
  misc_feature 1..3495: note = derived and/or modified CDS sequence (opt4) from CCHVF(CCHVF 3809-ST-2007)__KR814867.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcgtgaacggcttcgagatcgagagccacaagtgctactgcagcctgttctgctgcccctactgcagacactgcagcgccgacagagagatccaccagctgcacctgagcgtgtgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcagaagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctgacccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8866 - RNA, 3495 nt, synthetic construct
  misc_feature 1..3495: note = derived and/or modified CDS sequence (opt4) from CCHVF(CCHVF 3820-ST-2007)__KR814868.1__Gn-NSm-Gc
  source 1..3495: mol_type = other RNA
agcgaggagcccggcgacgactgcatcagcagaacccagctgctgaagaccgagaccgccgagatccacgacgacaactacggcagccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctggccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8867 - RNA, 3495 nt, synthetic construct
  misc_feature 1..3495: note = derived and/or modified CDS sequence (opt4) from CCHVF(CCHVF 4495-ST-2008)__KR814869.1__Gn-NSm-Gc
  source 1..3495: mol_type = other RNA
agcgaggagagcggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcctgttctgcaaggccctgttctacagcctgatcatcatcggcaccctgggcaagaagatcaagcagtacagagagctgagaccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagaaggaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagagatgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagagccagaggcctgctgaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8868 - RNA, 3495 nt, synthetic construct
  misc_feature 1..3495: note = derived and/or modified CDS sequence (opt4) from CCHVF(CCHVF 4691-ST-2009)__KR814871.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccaggccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaagaaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccgccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8869 - RNA, 3495 nt, synthetic construct
  misc_feature 1..3495: note = derived and/or modified CDS sequence (opt4) from CCHVF(CCHVF 4701-ST-2009)__KR814872.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcggcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8870 - RNA, 3495 nt, synthetic construct
  misc_feature 1..3495: note = derived and/or modified CDS sequence (opt4) from CCHVF(CCHVF 5170-R-2011)__KR814873.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgagggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8871 - RNA, 3495 nt, synthetic construct
  misc_feature 1..3495: note = derived and/or modified CDS sequence (opt4) from CCHVF(CCHVF Oman-199809166)__KR864901.1__Gn-NSm-Gc
  source 1..3495: mol_type = other RNA
agcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacaccagcatctgcctgttcgtgctgggcagcatcctgttcatcgtgagccacctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacaaggagatccacaagctgcacctgagcatctgcaagaagagaaaggccggcagcaacgtgatgctggccgtgtgcaagagaatgtgcttcagagccaccatggaggtgagcaacaaggccctgctgatcagaagcgtgatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8872 - RNA, 3495 nt, synthetic construct
  misc_feature 1..3495: note = derived and/or modified CDS sequence (opt4) from CCHVF(CCHVF 200406546-Turkey)__KR864902.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctgatcgacctgggctgcccccacgtgcccctgctgggcagaatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagttcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcatcgagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgaccgccagaaagctggagttcggcaccgacagcaccttcaaggccttcagcgccatgcccaagaccagcctgtgcttctacatcgtggagaaggagtactgcaagagctgcaacgaggacgacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacaagagaatcatcgagagactgaacaacaagaagggcaagaacagactgctggacggcgagagactggccgacagaaagatcgccgagctgttcagcaccaagacccacatcggc

SEQ ID NO: 8873 - RNA, 3495 nt, synthetic construct
  misc_feature 1..3495: note = derived and/or modified CDS sequence (opt4) from CCHVF(CCHVF 1-CR/HU-2015)__KU161584.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcagaacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8874 - RNA, 3495 nt, synthetic construct
  misc_feature 1..3495: note = derived and/or modified CDS sequence (opt4) from CCHVF(CCHVF 1231-CR/TI-2015)__KU161585.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggagagcgtgagcgacagcttcttccccggcctgagcgtgtgcagaacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8875 - RNA, 3495 nt, synthetic construct
  misc_feature 1..3495: note = derived and/or modified CDS sequence (opt4) from CCHVF(CCHVF Gaib)__KX013445.1__Gn-NSm-Gc
  source 1..3495: mol_type = other RNA
agcgaggagagcagcgacgactgcatcagcagaacccagctgctgagaaccgagaccgccgagatccacaacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcatccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcttctgcaaggccatcttctacctgctgatcatcgtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtggtgcactgccccaagagaaaggagaagatcgaggagaccgagctgtacctgaacctggagagagtgccctgggtggtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacaccagcatctgcctgttcgtgctgggcggcatcctgttcatcgtgagctgcctgatgaagggcctggtggacagcgtgggcaacaacttcttccccggcctgaccatctgcaagacctgcagcatcagcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcctgagagtgaccaccgaggtgagcaacagagccctgttcatcagaagcatcatcaacaccaccttcgtgatctgcatcctgatcctggccgtgtgcgtgatcagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcatcgagcacagaggcaacaagatcctggtgagcggcagaagcgagagcatcatgaagctggaggagagaaccggcatcagctgggacctgggcgtggaggacgccagcgagagcagactgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcagagaggacacccagaagtgcgtgagcaccaagctggagcagccccagagcatcctgatcgagcacaagggcaccatcatcggcaagcagaacaacacctgcaccaccaagaccacctgctggctggagagcgtgaagagcttcttctacggcctgaagaacatgctgagcagcatcttcggcaacgtgttcgtgggcatcttcagcttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagagcaagctgctggacggcgagagactggccgacagaaagatcgccgagctgttcagcaccaagacccacatcggc

SEQ ID NO: 8876 - RNA, 3495 nt, synthetic construct
  misc_feature 1..3495: note = derived and/or modified CDS sequence (opt4) from CCHVF(CCHVF Hodzha)__KX013448.1__Gn-NSm-Gc
  source 1..3495: mol_type = other RNA
agcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagaatccccctgctgggcaagatggccatctacatctgcagaatgagcaaccaccccgagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgttcgccgtgagcctgagccccgtgcagagcgcccccatcggccacggcaagaccatcgagacctaccaggccagagaggagtacaccagcatctgcctgttcgtgctgggcagcatcctgttcatcgtgagctgcctgatgaagggcctggtggacagcatcggcaacatcttcttccccggcctgaccatctgcaagacctgcagcatcggcagcatcaacggcttcgagatcgagagccacaagtgctactgcagcctgctgtgctgcccctactgcagacactgccccgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcaagaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgcagcgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcagaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcaagtacaagcacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8877 - RNA, 3495 nt, synthetic construct
  misc_feature 1..3495: note = derived and/or modified CDS sequence (opt4) from CCHVF(CCHVF IbAn7620)__KX013451.1__Gn-NSm-Gc
  source 1..3495: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgagatcgtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccagggcaagaccaccgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaaccccctgaacagcaccagcctggagaccagcctgagcatcgaggccccctggggcgccatcgacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccaacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8878 - RNA, 3495 nt, synthetic construct
  misc_feature 1..3495: note = derived and/or modified CDS sequence (opt4) from CCHVF(CCHVF K128_76)__KX013454.1__Gn-NSm-Gc
  source 1..3495: mol_type = other RNA
agcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcagccacggcaagaccatcgagacctaccaggtgagagaggagtacaccagcatctgcctgttcgtgctgggcagcatcctgttcatcgtgagctgcctgatgaagggcctggtgaacagcgtgggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgttcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttccaggacagcatcgtgaagggcatgaagaacctgctgaacagcaccagcctggagaccagcctgagcatcgaggccccctggggcgccatcaacgtgcagagcacctacaagcccgccgtgagcgccgccaacatcgccctgagctggagcagcgtggagcacagaggcagcaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggagaacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8879 - RNA, 3495 nt, synthetic construct
  misc_feature 1..3495: note = derived and/or modified CDS sequence (opt4) from CCHVF(CCHVF K168_40)__KX013457.1__Gn-NSm-Gc
  source 1..3495: mol_type = other RNA
agcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgaggtggacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcggccacggcaagaccatcgagacctaccaggtgagagaggagtacaccagcatctgcctgttcgtgctgggcagcatcctgttcatcgtgagctgcctgatgaagggcctggtgaacagcgtgggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccgtggaggtgagcaacaaggccctgagcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacggcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcatcaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8880 - RNA, 3495 nt, synthetic construct
  misc_feature 1..3495: note = derived and/or modified CDS sequence (opt4) from CCHVF(CCHVF K168_125)__KX013460.1__Gn-NSm-Gc
  source 1..3495: mol_type = other RNA
agcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgaggtggacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaaggtgcccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcggccacggcaagaccatcgagacctaccaggtgagagaggagtacaccagcatctgcctgttcgtgctgggcagcatcctgttcatcgtgagctgcctgatgaagggcctggtgaacagcgtgggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccgtggaggtgagcaacaaggccctgagcatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgaagggcaagaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcatcaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8881 - RNA, 3495 nt, synthetic construct
  misc_feature 1..3495: note = derived and/or modified CDS sequence (opt4) from CCHVF(CCHVF K229_194)__KX013463.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaagggcaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccagcttctgccaccaggagtgccaggtgaccgagaccgagtgcctgtgcccctacgaggccctggtgctgagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacagctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggc

SEQ ID NO: 8882 - RNA, 3495 nt, synthetic construct
  misc_feature 1..3495: note = derived and/or modified CDS sequence (opt4) from CCHVF(CCHVF K229_243)__KX013466.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctgacccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8883 - RNA, 3495 nt, synthetic construct
  misc_feature 1..3495: note = derived and/or modified CDS sequence (opt4) from CCHVF(CCHVF K315_14)__KX013469.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccgtggtggaccagagactgggcagcgagctgggctgctacaccatcaacagagtgaagagcttcaagctgtgcaagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgagggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtgtacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaagctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8884 - RNA, 3495 nt, synthetic construct
  misc_feature 1..3495: note = derived and/or modified CDS sequence (opt4) from CCHVF(CCHVF K323_27)__KX013472.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacctgctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgaccgtgctgctggtgctgctgaccgtgagcctgagccccgtgcagagcgcccccgtgggccacggcaacaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccccactgcagacacagaagcgccgacagagagatccaccagctgcacctgagcatctgcaagaagagaaagaccggcagcaacgtgatgctggccgtgtgcaagagaatgtgccccaaggccaccatcgaggccagcagaagagccctgcccatcagaagcatcatcaacaccaccctggtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccggccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaacgacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8885 - RNA, 3495 nt, synthetic construct
  misc_feature 1..3495: note = derived and/or modified CDS sequence (opt4) from CCHVF(CCHVF K340_6)__KX013475.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcaccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatcccccccctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgagcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtgaccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacttcaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8886 - RNA, 3495 nt, synthetic construct
  misc_feature 1..3495: note = derived and/or modified CDS sequence (opt4) from CCHVF(CCHVF Mamon)__KX013478.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgagcgacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccgtggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaagaccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8887 - RNA, 3495 nt, synthetic construct
  misc_feature 1..3495: note = derived and/or modified CDS sequence (opt4) from CCHVF(CCHVF Min)__KX013481.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcaccatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaccaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8888 - RNA, 3495 nt, synthetic construct
  misc_feature 1..3495: note = derived and/or modified CDS sequence (opt4) from CCHVF(CCHVF Nakiwogo)__KX013484.1__Gn-NSm-Gc
  source 1..3495: mol_type = other RNA
gccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcgtggtgtgcaaggtgctgttctacctgctgatcgtgatcggcaccctgggcaagaagctgaagcagtacagagagctgaagccccagacctgcatcgtgtgcgagagcatccccgtgaacgtgatcgacgccgagatgcacgagctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggccaggagaaggccatcgaggtgtaccaggtgagagagagctacaccagcatgtgcctgttcgtgctgggcagcgtgctgttcgccgtgagctggctggtgaagggcctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagatcacccacagaatgcacctgaacatctgcaagagaagaaaggtgggcagcaacgtgatgctggccgtgtgcaagagaatgtgcttcaaggccaccgtggaggccagcaacagcgccctgctgatcagaagcatcatcaacagcaccttcgtgatctgcgtgctgatcctggtgatctgcgtggtgagcaccagcgccgtggacatggagaacctgcccgccggcatctgggagagagaggaggacctgaccaacttctgccaccaggagtgccaggtgaccgagaccgagtgcctgtgcccctacgaggccctgatcctgagaaagcccctgtacctggacagcatcgccaagggcatgaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacgtgcagcagagactgcccagcgagatcgtgaccctgcaccccaagatcgaggagggcttcttcgacctgatgcacgtgcagaaggtgctgttctgcaagcacagcctgcaggccaccagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcgtgaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagctgggcgccgacagcaccttcaaggccttcagcagcatgcccaagaacagcctgtgcttctacatcgtggagagagactactgcagcagctgcaccgacgacgacacccagaagtgcgtgaacaccaagctggagcacccccagagcatcctgatcgagcacaagggcaccatcatcggcaagcagaacgacacctgccccaccaagaccagctgctggctggagagcgtgaagagcttcttctacggcctgaagaacatgctgggcggcatcttcggcaacgtgttcctgggcatcttcctgttcctggcccccttcgccctgctgatcctgttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccgagctgttcagcaccaagacccacatcggc

SEQ ID NO: 8889 - RNA, 3495 nt, synthetic construct
  misc_feature 1..3495: note = derived and/or modified CDS sequence (opt4) from CCHVF(CCHVF Saf)__KX013487.1__Gn-NSm-Gc
  source 1..3495: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcactacctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcctggtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagagccctgctgatcagaagcatcatcaacaccaccttcgtgatctgcatcctgaccctgaccatctgcgtggtgagcaccagcgccgtggagatggagaacctgcccagcggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacatgaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgtgagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8890 - RNA, 3495 nt, synthetic construct
  misc_feature 1..3495: note = derived and/or modified CDS sequence (opt4) from CCHVF(CCHVF Ast199)__KX056051.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagatgcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggc

SEQ ID NO: 8891 - RNA, 3495 nt, synthetic construct
  misc_feature 1..3495: note = derived and/or modified CDS sequence (opt4) from CCHVF(CCHVF Ast149)__KX056054.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgcccatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggccctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggc

SEQ ID NO: 8892 - RNA, 3495 nt, synthetic construct
  misc_feature 1..3495: note = derived and/or modified CDS sequence (opt4) from CCHVF(CCHVF Ast137)__KX056057.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatccacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccaacatctgcctgttcatgctgggcagcatcctgttcatcgtgagctacctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgggcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgaccctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcaccaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggc

SEQ ID NO: 8893 - RNA, 3495 nt, synthetic construct
  misc_feature 1..3495: note = derived and/or modified CDS sequence (opt4) from CCHVF(CCHVF Ast133)__KX056060.1__Gn-NSm-Gc
  source 1..3495: mol_type = other RNA
agcgaggagcccgacgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacctgctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatgtgcatcctgaccctggccatctgcgtggtgagcaccagcgccgtggagatggaggacctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcagcaagacccacatcggc

SEQ ID NO: 8894 - RNA, 3495 nt, synthetic construct
  misc_feature 1..3495: note = derived and/or modified CDS sequence (opt4) from CCHVF(CCHVF SK/2015/human)__KX458183.1__Gn-NSm-Gc
  source 1..3495: mol_type = other RNA
agcgaggagagcggcgacgactgcatcagcagaaccagactgctgagaaccgagaccgccgagatccacggcgacagctacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgagatgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaccatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccacggcaagaccatcgagacctaccaggccagagaggagtacaccggcatctgcctgttcgtgctgggcagcatcctgttcatcgtgagctgcctggtgaagggcctggtggacggcgtgggcaacatcttcttccccggcctgagcatctgcaagacctgcagcatcggcagcatcaacggcttcgagatcgagagccacaagtgctactgcagcctgctgtgctgcccctactgcagacactgcagcgccgacagagagatccaccagctgcacctgagcatctgcaagaagagaaagaccggcagcaacgtgatgctggccgtgtgcaagagaatgtgcttcagagccaccatggaggtgagcaacaaggccctgctgatcagaagcatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaagacccctgttcctggacagcatcgtgagaggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcgtgagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccagggcagacagtgcagcctgatcgaggccggcaccagattcaacctgggcagcgtgaccatcaccctgagcgagcccagaaacatccagcacaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacagaggcaccatcatcggcaagcagaacaacacctgcatcgccaaggccagctgctggctggagagcgtgaagagcttcttctacggcctgaagaacatgctgagcggcatcttcggcaacctgttcctgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8895 - RNA, 3495 nt, synthetic construct
  misc_feature 1..3495: note = derived and/or modified CDS sequence (opt4) from CCHVF(CCHVF YL16070)__KY354081.1__Gn-NSm-Gc
  source 1..3495: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagagactgggcagcgagctgggctgctacaccatcaacagagtgaagagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgtgtgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatgagccccgtgcagagcgcccccgtgggcaaggagagagccatcgagacctaccaggccagagaggcctacaccggcatctgcctgttcgtgctgggcagcgtgctgttcgccgtgagctggctgaccaaggccctgatcgacggcatcggcaacagcttcttccccggcctgagcgtgtgcaagacctgcagcatcggcagcatcaacggcttcgagatcgagagccacaagtgctactgcagcctgttctgctgcccctactgcagagcctgcagcagcgacaagaacacccacagaatgcacctgaacgtgtgcaagaagagaaagatgggcagcaacgtgatgctggccgtgtgcaagagaatgtgcttcagagccaccatcgaggccagcaacaaggccctgctgatcagaagcatcatcaacagcaccttcgtgatctgcatcctgatcctgaccatctgcgtggtgagcaccagcgccgtggacatggagaacctgcccgccggcatctgggagaaggaggaggacctgaccaacttctgccaccaggagtgccaggtgaccgagaccgagtgcctgtgcccctacgaggccatggtgctgagaaagcccctgttcctggacagcatcgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccaggtgtaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctgaagagcttcaagggcttcttctacggcctgaagaacatgctgagcggcatcttcggcaacgtgttcctgggcatcctgctgttcctggcccccttcgtgctgctgatcttcttcttcttcttcggctggagactgctgttctgcctgaagtgctgcaagaagaccaagggcctgctgaagtacaagcacctgaaggacaaggaggaggccggctacaagaagatcatcgagagactgaacggcaagaagggcaagagccagctgttcgacggcgagagactggccaacagaaagatcgccgagctgttcagcaccaagatccacatcggc

SEQ ID NO: 8896 - RNA, 3495 nt, synthetic construct
  misc_feature 1..3495: note = derived and/or modified CDS sequence (opt4) from CCHVF(CCHVF Oman_812956)__KY362518.1__Gn-NSm-Gc
  source 1..3495: mol_type = other RNA
agcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggccacggcaagaccatcgagacctaccagaccagagagggctacaccagcatctgcctgttcgtgctgggcagcatcctgttcatcgtgagccacctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacaaggagatccacaagctgcacctgagcatctgcaagaagagaaaggccggcagcaacgtgatgctggccgtgtgcaagagaatgtgcttcagagccaccatggaggtgagcaacaaggccctgctgatcagaagcgtgatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcttcgacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8897 - RNA, 3495 nt, synthetic construct
  misc_feature 1..3495: note = derived and/or modified CDS sequence (opt4) from CCHVF(CCHVF UCCR4405)__KY484029.1__Gn-NSm-Gc
  source 1..3495: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggccacggcaagaccatcgagacctaccagaccagagagggcttcaccagcatctgcctgttcatgctgggcagcatcctgttcatcgtgagctgcctggtgaagggcctggtggacagcgtgagcgacagcttcttccccggcctgagcgtgtgcaagacctgcagcatcggcagcatcaacggcttcgagatcgagagccacaagtgctactgcagcctgttctgctgcccctactgcagacactacagcgccgacagagagatccaccagctgcacctgagcatctgcaagaagagaaagaccggcagcaacgtgatgctggccgtgtgcaagagaatgtgcttcaaggccaccatcgaggccagcagaagagccctgctgatcagaagcatcatcaacaccaccttcgtgatctgcatcctgatcctggccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcaactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggtgtgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcatcttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8898 - RNA, 3495 nt, synthetic construct
  misc_feature 1..3495: note = derived and/or modified CDS sequence (opt4) from CCHVF(CCHVF UCCR4459)__KY484032.1__Gn-NSm-Gc
  source 1..3495: mol_type = other RNA
agcgaggagagcggcgacgactgcatcagcagaacccagctgagcagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccatcaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggccacggcaagaccgtggagacctaccagaccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcggcagcatcaacggcttcgagatcgagagccacaagtgctactgcagcctgttctgctgcccctactgcagacactgcagcgccgacagagagatccacaagctgcacctgagcatctgcaagaagagaaagaccggcagcaacgtgatgctggccgtgtgcaagagaatgtgcttcagagccaccgtggaggtgagcaacaaggccctgctgatcagaaacatcatcaacaccaccttcgtggtgtgcatcctgatcctggccgtgtgcgtggtgagcaccagcgccgtggagatggagagcctgcccgccggcacctgggagagagaggaggacctgaccaacttctgccaccaggagtgccaggtgaccgagaccgagtgcctgtgcccctacgaggccctggtgctgagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8899 - RNA, 3495 nt, synthetic construct
  misc_feature 1..3495: note = derived and/or modified CDS sequence (opt4) from CCHVF(CCHVF UCCR4401)__KY484035.1__Gn-NSm-Gc
  source 1..3495: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgagaagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacagaagaatcgccgagctgttcagcaccaagacccacatcggc

SEQ ID NO: 8900 - RNA, 3495 nt, synthetic construct
  misc_feature 1..3495: note = derived and/or modified CDS sequence (opt4) from CCHVF(CCHVF UCCR4448)__KY484042.1__Gn-NSm-Gc
  source 1..3495: mol_type = other RNA
agcgaggagaccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccatcagcctgagccccgtgcagagcgcccccatcagccacggcaagaccatcgaggcctacagagccagagagggctacaccagcatctgcctgttcgtgctgggcagcatcctgttcatcgtgagctacctgatgaagggcctggtggacagcgtgggcaacagcttcttccccggcctgagcatctgcaagacctgcagcaccagcagcatcaacggcttcgagatcgagagccacaagtgctactgcagcctgttctgctgcccctactgcagacactgcagcgccgacaaggagatccacaagctgcacctgagcatctgcaagaagagaaagaccggcagcaacgtgatgctggccgtgtgcaagagaatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagaagaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagatcctggccgacagaagaatcgccgagctgttcagcaccaagacccacatcggc

SEQ ID NO: 8901 - RNA, 3495 nt, synthetic construct; identical to SEQ ID NO: 8817
  misc_feature 1..3495: note = derived and/or modified CDS sequence (opt4) from CCHVF(CCHVF SPU4/81 )__DQ157175.1__Gn-NSm-Gc
  source 1..3495: mol_type = other RNA

SEQ ID NO: 8902 - RNA, 3495 nt, synthetic construct; identical to SEQ ID NO: 8838
  misc_feature 1..3495: note = derived and/or modified CDS sequence (opt4) from CCHVF(CCHVF Sudan Al-Fulah 9-2008)__HQ378185.1__Gn-NSm-Gc
  source 1..3495: mol_type = other RNA

SEQ ID NO: 8903 - RNA, 3495 nt, synthetic construct; identical to SEQ ID NO: 8832
  misc_feature 1..3495: note = derived and/or modified CDS sequence (opt4) from CCHVF(CCHVF NIV161064)__KY213713.1__Gn-NSm-Gc
  source 1..3495: mol_type = other RNA

SEQ ID NO: 8904 - RNA, 3495 nt, synthetic construct; identical to SEQ ID NO: 8854
  misc_feature 1..3495: note = derived and/or modified CDS sequence (opt4) from CCHVF(CCHVF 5180-R-2011)__KR814874.1__Gn-NSm-Gc
  source 1..3495: mol_type = other RNA

SEQ ID NO: 8905 - RNA, 3495 nt, synthetic construct; identical to SEQ ID NO: 8862
  misc_feature 1..3495: note = derived and/or modified CDS sequence (opt4) from CCHVF(CCHVF 4574-ST-2008)__KR814870.1__Gn-NSm-Gc
  source 1..3495: mol_type = other RNA

SEQ ID NO: 8906 - RNA, 3495 nt, synthetic construct; identical to SEQ ID NO: 8814
  misc_feature 1..3495: note = derived and/or modified CDS sequence (opt4) from CCHVF(CCHVF 3010)__DQ019222.1__Gn-NSm-Gc
  source 1..3495: mol_type = other RNA

SEQ ID NO: 8907 - RNA, 3495 nt, synthetic construct; identical to SEQ ID NO: 8814
  misc_feature 1..3495: note = derived and/or modified CDS sequence (opt4) from CCHVF(CCHVF UG3010)__DQ211637.1__Gn-NSm-Gc
  source 1..3495: mol_type = other RNA

SEQ ID NO: 8908 - RNA, 2916 nt, synthetic construct
  misc_feature 1..2916: note = derived and/or modified CDS sequence (opt4) from CCHFV(10200, Artificial)__U39455.2__Gn-4aa-Gc
  source 1..2916: mol_type = other RNA
agcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgagaagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggcagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggc

SEQ ID NO: 8909 - RNA, 2916 nt, synthetic construct
  misc_feature 1..2916: note = derived and/or modified CDS sequence (opt4) from CCHFV(IbAr10200, Artificial)__AF467768.2__Gn-4aa-Gc
  source 1..2916: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgagaagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggcagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtgggcgagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacagaagaatcgccgagctgttcagcaccaagacccacatcggc

SEQ ID NO: 8910 - RNA, 2916 nt, synthetic construct
  misc_feature 1..2916: note = derived and/or modified CDS sequence (opt4) from CCHFV(Turkey-Kelkit06, Artificial)__GQ337054.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcagaatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggtgcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggagccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggccctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcggcatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggc

SEQ ID NO: 8911 - RNA, 2919 nt, synthetic construct
  misc_feature 1..2919: note = derived and/or modified CDS sequence (opt4) from CCHFV(SR3, Artificial)__AJ538199.1__Gn-4aa-Gc
  source 1..2919: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggcctgagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcaacaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8912 - RNA, 2919 nt, synthetic construct
  misc_feature 1..2919: note = derived and/or modified CDS sequence (opt4) from CCHFV(UCCR4413, Artificial)__KY484038.1__Gn-4aa-Gc
  source 1..2919: mol_type = other RNA
agcgagagcagcgccagcggctgcatcagcagaacccagatgatcaagagcgagaccgccgagatccacgacgacatctacggcggccccggcgagaagctgaccatctgcaacggcaccaccgtggtggaccagagactgggcagcgagctgggctgctacaccatcaacagaatcaagacctacaagctgtgcgagaacagcgtgaaggagaagacctgcgagatcgacagcgtgcccgtgaagtgcagacagggcctgtgcctgaagatcacccaggagggcagaggccacgtgaagctgagcagaggcagcgagatcgtgctggacatctgcgacagcagctgcgagctgatgatccccaagggcaccggcgacatcctggtggactgcagcggcggccagcagcacttcctgcaggacaacctggtggacctgggctgccccaacatccccctgctgggcaaggtggccatctacatctgcagaatgagcaaccaccccaagaccaccatggccttcctgttctggttcagcttcggctacgtgatcacctgcatcctgtgcaagatcctgttctacctgctgatcatcaccggcaccctgggcaagaagctgaagcagtacagagagctgaagccccagacctgcaccatctgcgagagcacccccgtgaacgccatcgacgccgagatgcacgacctgaactgcagctacaacatctgcccctactgcgccagcagactgaccagcgacggcctgatcagacacgtgaacctgtgccccaagagaaaggagaaggtggaggagaccgagctgtacctgaacctggagagaatcccctggttcgtgagaaagctgctgcaggtgagcgagagcaccggcgtggccctgaagagaagcagctggctgctgatcctggtgatcctgctgaccgtgagcatgagccccgtgcagagcgcccccatcaacagaaagcccctgttcctgagcagcatcgtgaagggcaagaagaacctgctgaacagcgccagcctggagaccagcctgagcatcgaggccccctggggcgccatcaacgcccagagcaccttcaagcccaccatcagcaccgccaacatcgccctgagctggagcagcgtggagcacagaggcaacaaggtgctggtgagcggcagaagcgagagcatcatgaagctggaggagagaaccggcatcagctggaacctgggcgtggaggacgccagcgagagcagaatgctgaccgtgagcgtgatggacctgagccagatgtacctgcccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgcccagcgagatcgtgaccctgcaccccaagatcgaggagggcttcttcgacctgatgcacgtgcagaaggtgctgagcgccagcaccgtgtgcaagctgcagagctgcacccacggcgtggccggcgacctgcaggtgtaccacgtgggcaacctgctgaagggcgacaagatcaacggccacagcatccacaagatcgagccccacctgaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagagcttccacttccacagcaagagagtgaccgcccacggcgacaccccccagctggacctgaaggccagacccatgtacggcgccggcgagatcaccgtgctggtggaggtggccgacatggagctgcacagcaagaacatcgagatcagcggcctgaagttcgccagcctgacctgcagcggctgctacgcctgcagcagcggcatcagctgcaaggtgagaatccacgtggacgagcccgacgagctggccgtgcacgtgaagagcgacgacctggacgtggtggccgccagcagcagcctgatggccagaaagatcgagttcggcaccgacagcaccttcaaggccttcagcagcatgcccaaggagagcctgtgcttctacatcgtggagagagacttctgcaagagctgcgccgccgaggacacccagaagtgcgtgaaggccaagctggagcagccccagagcatcctgatcgagcacaagggcaccatcatcggcaagcagaacgacacctgcagcaccaagaccagctgctggctggagagcttcaagagcttcttctacggcctgaagaacatgctgagcggcgtgttcggcagcgccatcatgggcatcctgctgttcctggcccccttcatcctgctgatcctgttcttcttcttcggctggagaatcctgttctgcctgagatgctgcagaagaaccagaggcctgttcaagtacaagcacatcaaggacgacgaggaggccggctacaagaagatcatcgagaagctgaacaacaagaagggcggcaccagcaagctgctggacggcgagagactggccgacagaaagatcgccgagctgttcagcaccaaggcccacatcggc

SEQ ID NO: 8913 - RNA, 2916 nt, synthetic construct
  misc_feature 1..2916: note = derived and/or modified CDS sequence (opt4) from CCHFV(66019, Artificial)__AB069669.1__Gn-4aa-Gc
  source 1..2916: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccatcgtggaccagagactgggcagcgagctgggctgctacaccatcaacagagtgaagagcttcaagctgtgcgagaacagcggcaccggcaagagctgcaagatcgacaacacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcttctgcaagatcatcttctacctgctgatcgtggtgggcaccctgggcaagaagttcaagcagtacagagagctgaagccccagacctgcaccatctgcgagaccacccccaccaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggcagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcaactgccccgacagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaacagccaggagagacagtgcagcctgatcgaggccggcaccagattcaacctgggccccgtgaccatcaccctgagcgagcccagaaacatccagcagaagctgcccagcgagatcatcaccctgcaccccagaatcgaggagggcttcttcgacctgatgcacgtgcagaaggtgctgagcgccagcaccgtgtgcaagctgcagagctgcacccacggcgtgcccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgccatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagatacctgaaggacgacgaggagagcggctacagaagaatcatcgagagactgaacaacaagaagggcaagaacaagctgctggacggcgagagactggccgacagaagaatcgccgagctgttcagcaccaagacccacatcggc

SEQ ID NO: 8914 - RNA, 2916 nt, synthetic construct
  misc_feature 1..2916: note = derived and/or modified CDS sequence (opt4) from CCHFV(7001, Artificial)__AB069670.1__Gn-4aa-Gc
  source 1..2916: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagagactgggcagcgagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggcagaaagcccctgttcctggacaacatcgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccaggtgtaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcttcctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggc

SEQ ID NO: 8915 - RNA, 2916 nt, synthetic construct
  misc_feature 1..2916: note = derived and/or modified CDS sequence (opt4) from CCHFV(75024, Artificial)__AB069671.1__Gn-4aa-Gc
  source 1..2916: mol_type = other RNA
agcgaggagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagcatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccatcagcctgagccccgtgcagagcgcccccatcggcagaagacccctgttcctggacagcatcgtgagaggcatgaagaaccagctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgatcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacctgatccacaagatcgagccccacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagttcacccccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacctgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8916 - RNA, 2916 nt, synthetic construct
  misc_feature 1..2916: note = derived and/or modified CDS sequence (opt4) from CCHFV(7803, Artificial)__AB069672.1__Gn-4aa-Gc
  source 1..2916: mol_type = other RNA
agcgaggagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtgatcctggacgcctgcgacagcagctgcgaggtgatgatccccaagggcaccggcgacatcctggtggactgcagcggcggccagcagcacttcctgaaggacaacctgatcgacctgggctgccccagcatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccatcagcctgagccccgtgcagagcgcccccatcagcagaagacccctgttcctggacagcatcgtgagaggcatgaagaaccccctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgatcgtgaagtggaaggtggagtacatcaagaccagaggcatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacctgatccacaagatcgagccccacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagttcacccccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacttcttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8917 - RNA, 2916 nt, synthetic construct
  misc_feature 1..2916: note = derived and/or modified CDS sequence (opt4) from CCHFV(79121, Artificial)__AB069673.1__Gn-4aa-Gc
  source 1..2916: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagggcctgggcagcgagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggcagaaagcccctgttcctggacagcaccgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccagatctaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaacctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcttcctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggc

SEQ ID NO: 8918 - RNA, 2916 nt, synthetic construct
  misc_feature 1..2916: note = derived and/or modified CDS sequence (opt4) from CCHFV(8402, Artificial)__AB069674.1__Gn-4aa-Gc
  source 1..2916: mol_type = other RNA
agcgaggagagcggcgacgactgcatcagcagaacccagctgctgagaaccgagaccgccgagatccacaacgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggcagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagagcaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8919 - RNA, 2916 nt, synthetic construct
  misc_feature 1..2916: note = derived and/or modified CDS sequence (opt4) from CCHFV(88166, Artificial)__AB069675.1__Gn-4aa-Gc
  source 1..2916: mol_type = other RNA
agcgaggagagcggcgacgactgcatcagcagaacccagctgctgagaaccgagaccgccgagatccacagcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatgggcttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggcagaaagcccctgttcagcgacagcatcgtgaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctggaacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacctggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8920 - RNA, 2916 nt, synthetic construct
  misc_feature 1..2916: note = derived and/or modified CDS sequence (opt4) from CCHFV(BA88166, Artificial)__AF338470.1__Gn-4aa-Gc
  source 1..2916: mol_type = other RNA
agcgaggagagcggcgacgactgcatcagcagaacccagctgctgagaaccgagaccgccgagatccacagcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatgggcttcctgttctggttcagcttcggctacgtggtgacctgcatcctgtgcaagggcatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggcagaaagcccctgtacctggacagcatcgtgaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctggaacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgatcatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8921 - RNA, 2916 nt, synthetic construct
  misc_feature 1..2916: note = derived and/or modified CDS sequence (opt4) from CCHFV(BA66019, Artificial)__AF350448.1__Gn-4aa-Gc
  source 1..2916: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccatcgtggaccagagactgggcagcgagctgggctgctacaccatcaacagagtgaagagcttcaagctgtgcgagaacagcggcaccggcaagagctgcaagatcgacaagcaccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcttctgcaagatcatcttctacctgctgatcgtggtgggcaccctgggcaagaagttcaagcagtacagagagctgaagccccagacctgcaccatctgcgagaccacccccaccaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggcagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgacagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaacagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgccatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagatacctgaaggacgacgaggagagcggctacagaagaatcatcgagagactgaacaacaagaagggcaagaacaagctgctggacggcgagagactggccgacagaagaatcgccgagctgttcagcaccaagacccacatcggc

SEQ ID NO: 8922 - RNA, 2916 nt, synthetic construct
  misc_feature 1..2916: note = derived and/or modified CDS sequence (opt4) from CCHFV(BA8402, Artificial)__AF350449.1__Gn-4aa-Gc
  source 1..2916: mol_type = other RNA
agcgaggagagcggcgacgactgcatcagcagaacccagctgctgagaaccgagaccgccgagatccacaacgacaactacggcggccccggcgacaagatcaccatctgcaacggcagcaccgtggtggaccagagactgggcagcgagctgggctgctacaccatcaacagagtgaacagcttcaacctgtgcgagaacaccgccaccggcaagagctgcgagatcgacagcacccccgtgaagtgcagacagggcttctgcctgaagatcacccaggagggcagaggccacgtgaagctgagcagaggcagcgaggtggtgctggacgcctgcgagagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagacccaccagcgacggcctggccagacacgtgatgcagtgccccaagagaaaggagaagatcgaggagaccgccctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggcagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctgcactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagagcaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8923 - RNA, 2916 nt, synthetic construct
  misc_feature 1..2916: note = derived and/or modified CDS sequence (opt4) from CCHFV(Matin, Artificial)__AF467769.2__Gn-4aa-Gc
  source 1..2916: mol_type = other RNA
agcgaggagagcggcgacgactgcatcagcagaacccagctgctgagaaccgagaccgccgagatccacagcgacagctacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggtgttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggcagaaagcccctgttcctggacagcatcatcaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggtgatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgagcatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcgccctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacgtgggc

SEQ ID NO: 8924 - RNA, 2916 nt, synthetic construct
  misc_feature 1..2916: note = derived and/or modified CDS sequence (opt4) from CCHFV(Baghdad 12, Artificial)__AJ538197.2__Gn-4aa-Gc
  source 1..2916: mol_type = other RNA
agcgaggagagcggcgacgactgcatcagcagaaccagactgctgagaaccgagaccgccgagatccacggcgacagctacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcaagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctggccgtgagcagcagccccgtgcagagcgcccccatcggcagaaagcccctgttcctggacagcatcgtgaagggcaccaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgacgccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggtgagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacttcttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8925 - RNA, 2916 nt, synthetic construct
  misc_feature 1..2916: note = derived and/or modified CDS sequence (opt4) from CCHFV(VLG/TI29414, Artificial)__AY179961.1__Gn-4aa-Gc
  source 1..2916: mol_type = other RNA
agcgaggagcccggcgacgactgcatcagcagaacccagctgctgagagccgagcccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggaacgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccaacctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctgggaggtgggcaccggctgcacctgctgcggctggaacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcatgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtgatcgccgccagcaccagcctgatggccagaaagctggagttcggcaccgacagcaccttcaaggccttcagcgccatgcccaagaccagcctgtgcttctacatcgccgagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8926 - RNA, 2916 nt, synthetic construct
  misc_feature 1..2916: note = derived and/or modified CDS sequence (opt4) from CCHFV(TADJ/HU8966, Artificial)__AY179962.1__Gn-4aa-Gc
  source 1..2916: mol_type = other RNA
agcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcagcgtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcaccagaatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagagagtggaggagaccgagctgtacctgaacctggagagaatcccctggatcgtgagaaagctgctgcaggtgagcgagagcaccggcgtggccctgaagagaagcagctggctgatcgtgctgctggtgctgttcaccgtgagcctgagccccgtgcagagcgcccccatcggcagaagacccctgttcctggacagcatcgtgaagggcatgaagaaccccctgaacagcaccagcctggagaccagcctgagcatcgaggccccctggggcgccatcaacgtgcagagcacctacaagcccaccgtgagcaccgccaacatcgccctgagctggagcagcatcgagcacagaggcaacaacatcctggtgagcggcagaagcgagagcatcatgaagctggaggagagaaccggcatcagcggcgacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcatcgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggagaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtacagaaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgagctgcttcaagtgctgcagaagaaccagaggcctgctgaagcacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8927 - RNA, 2916 nt, synthetic construct
  misc_feature 1..2916: note = derived and/or modified CDS sequence (opt4) from CCHFV(Hodzha, Artificial)__AY223476.1__Gn-4aa-Gc
  source 1..2916: mol_type = other RNA
agcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagagctgcgagatcgacagcacccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagaatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgttcgccgtgagcctgagccccgtgcagagcgcccccatcggcagaagacccctgttcctggacagcatcgtgaagggcaccaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagagaaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcaagtacaagcacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8928 - RNA, 2916 nt, synthetic construct
  misc_feature 1..2916: note = derived and/or modified CDS sequence (opt4) from CCHFV(Kosovo/9553/2001, Artificial)__AY675511.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatcgccagaatgagcaaccaccccaagaccaccatggccttcctgttctggttcagcctgggctacgtgatcacctgcatcctgtgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgaagcagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcaagagctgcagcgaggacgacaccaagaagtgcgtggacaccaagctggagcagccccagagcatcctgatcgagcacagaggcaccatcatcggcaagcccaacgacacctgccccgccaagaccagctgctggctggagagcgtgaagagcttcttctacggcctgaagaacatgctgggcagcgtgttcggcaacttcttcatcggcatcctgctgttcctggcccccttcttcctgtggatgctgagcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8929 - RNA, 2916 nt, synthetic construct
  misc_feature 1..2916: note = derived and/or modified CDS sequence (opt4) from CCHFV(SPU41/84, Artificial)__AY900142.1__Gn-4aa-Gc
  source 1..2916: mol_type = other RNA
agcgaggagagcagcgacgactgcatcagcagaacccagctgctgagaaccgagaccgccgagatccacggcgacaactacggcggccccggcgacaagatcaccatctgcaacggcagcaccgtggtggaccagagactgggcagcgagctgggctgctacaccatcaacagagtgaagaccttcaagctgtgcgagaacagcgccaccggcaagagctgcgagatcgacagcgtgcccgtgaagtgcagacagggctactgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcatctgcaaggtgatcttctacctgctgatcatcgtgggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcagcagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctggtgcacaagatcgagccccacttcaacaccagctggatgagctgggacggctgcgacctggactactactgcaacatgggcgactggcccagctgcacctacaccggcgtgacccagcacaaccacgccagcttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcaccagcctgacctgcaccggctgctacgcctgcagcagcggcatcagctgcaaggtgagaatccacgtggacgagcccgacgagctgaccgtgcacgtgaagagcgaggaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtgaacaccaagctggagcagccccagagcatcctgatcgagagaaagggcaccatcatcggcaagcagaacaacacctgcaaggccaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaagaatcgccgagctgttcagcaccaagacccacatcggc

SEQ ID NO: 8930 - RNA, 2916 nt, synthetic construct
  misc_feature 1..2916: note = derived and/or modified CDS sequence (opt4) from CCHFV(UG3010, Artificial)__AY900143.1__Gn-4aa-Gc
  source 1..2916: mol_type = other RNA
gccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcatcgtgtgcaaggtgctgttctacctgctgatcgtgatcggcaccctgagcaagaagctgaagcagtacagagagctgaagccccagacctgcatcgtgtgcgagagcacccccgtgaacgccatcgacgccgagatgcacgagctgaactgcaactacaacatctgcccctactgcgccagcagactgaccagcgacggcctggtgagacacgtgaaccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggcagaaagcccctgtacctggacagcatcgccaagggcatgaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccaggagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacatccagcagagactgcccagcgagatcgtgaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcagcgaccccgacgtggtggccgccggcagcagcctgatggccagaaagatcgagttcggcgccgacagcaccttcaaggccttcagcagcatgcccaagaacagcctgtgcttctacatcgtggagagagactactgcagcagctgcaccaacgacgacacccagaagtgcgtggacaccaagctggagcacccccagagcatcctgatcgagcacaagggcaccatcatcggcaagcagaacgacacctgcagcaccaagaccagctgctggctggagagcgtgaagagcttcttctacggcctgaagaacatgctgggcggcatcttcggcaacgtgttcctgggcatcttcctgttcctggcccccttcgccctgctgatcttcttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccgagctgttcagcaccaagacccacatcggc

SEQ ID NO: 8931 - RNA, 2916 nt, synthetic construct
  misc_feature 1..2916: note = derived and/or modified CDS sequence (opt4) from CCHFV(Hy13, Artificial)__AY900145.1__Gn-4aa-Gc
  source 1..2916: mol_type = other RNA
agcgaggagagcggcgacgactgcatcagcagaacccagctgagcagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccatcaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggcagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8932 - RNA, 2916 nt, synthetic construct
  misc_feature 1..2916: note = derived and/or modified CDS sequence (opt4) from CCHFV(Semunya, Artificial)__DQ094832.1__Gn-4aa-Gc
  source 1..2916: mol_type = other RNA
gccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcgtggtgtgcaaggtgctgttctacctgctgatcgtgatcggcaccctgggcaagaagctgaagcagtacagagagctgaagccccagacctgcatcgtgtgcgagagcatccccgtgaacgccatcgacgccgagatgcacgagctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggcagaaagcccctgttcctggacagcatcgccaagggcaagaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacgtgcagcagagactgcccagcgagatcgtgaccctgcaccccaagatcgaggagggcttcttcgacctgatgcacgtgcagaaggtgctgttctgcaagtacagcctgcaggccaccagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcgtgaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagttcggcgccgacagcaccttcaaggccttcagcagcatgcccaagaacagcctgtgcttctacatcgtggagagagactactgcagcagctgcaccgacgacgacacccagaagtgcgtgaacatcaagctggagcacccccagagcatcctgatcgagcacaagggcaccatcatcggcaagcagaacgacacctgccccaccaagaccagctgctggctggagagcgtgaagagcttcttctacggcctgaagaacatgctgggcggcatcttcggcaacgtgttcctgggcatcttcctgttcctggcccccttcgccctgctgatcctgttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccaagctgttcagcaccaagacccacatcggc

SEQ ID NO: 8933 - RNA, 2916 nt, synthetic construct
  misc_feature 1..2916: note = derived and/or modified CDS sequence (opt4) from CCHFV(SPU128/81/7, Artificial)__DQ157174.1__Gn-4aa-Gc
  source 1..2916: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgagagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggcagaaagcccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatcggcatcttcctgttcctgggccccttcatcctgctgatcctgttcttcatgttcggctggagaatcctgttctgcttcaagtgctgcagaagaaccagaggcctgctgaagtacagacacctgaaggaggacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8934 - RNA, 2916 nt, synthetic construct
  misc_feature 1..2916: note = derived and/or modified CDS sequence (opt4) from CCHFV(ROS/HUVLV-100, Artificial)__DQ206448.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8935 - RNA, 2916 nt, synthetic construct
  misc_feature 1..2916: note = derived and/or modified CDS sequence (opt4) from CCHFV(AP92, Artificial)__DQ211625.1__Gn-4aa-Gc
  source 1..2916: mol_type = other RNA
agcgagggcggcgacggcggctgcatcagcagaacccagctgatcaagaccgagaccgccgaggtgcacggcgacgactacggcggccccggcgagaagatcaccatctgcaacggcagcaccatcgtggaccagagactgggcagcgagctgggctgctacaccatcaacagaatcaagagcttcaagctgtgcgagaacagcgcccagggcaagaactgcgagatcgacagcgcccccgtgcagtgcagacagggctactgcctgaagatcagccaggagggcagaggccacgtgaagctgagcagaggcagcgagatcgtgctggacgtgtgcgacaccagctgcgagatcatgatccccaagggcaccggcgacatcctggtggactgcagcggcggccagcagcacttcctgcagagcaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaagaccctgttctacatcctgatcatcatcggcaccctgggcaagaagctgaagcagtacagagagctgaagccccagacctgcaccatctgcgagagcgtgcccgtgaacgccatcgacgccgagatgcacgacctgaactgcagctacaacatctgcccctactgcgccagcagactgaccagcgagggcctgaccagacacgtgaaccagtgccccaagagaaaggagaaggtggaggagaccgagctgtacctgaacctggagagaatcccctggatcgtgagaaagctgctgcaggtgagcgagagcaccggcgtggccctgaagagaagcagctggatgatcgtgctgctgatcctgctgatcgtgagcatgagccccgtgcagagcgcccccatcagcagaaagcccctgttcctggacagcatcgccaagggcgtgaagaacctgctgaacagcaccagcctggagaccagcctgagcatcgaggccccctggggcgccatcaacgcccagagcacctacaagcccaccgccagcagcgccaacatcgccctgacctggagcagcgtggagcacagaggcaacaagatcctggtgagcggcagaagcgagagcatcatgaagctggaggagagaaccggcatcagctggaacctgggcgtggaggacgccagcgagagcagaaccctgaccatcagcgtgatggacctgagccagatgtacagccccgtgttcgagtacctgagcggcgacagacaggtggaggagtggcccaaggccacctgcaccggcaactgccccgagagatgcggctgcaccagcagcacctgcctgtacaaggagtggccccacagcagaaactggagatgcaaccccacctggtgctggggcgtgggcaccggctgcacctgctgcggcctggacgtgaaggagctgttcaccgaccacatgctggtgaagtggaaggtggagtacatcaagaccgaggccatcgtgtgcgtggagctgaccagccaggagagacagtgcagcctgatcgaggccggcaccagattcagcctgggccccgtgaccatcaccctgagcgagcccagaaacatccagcagaagctgccccccgagctgatcaccctgcaccccaagatcgaggacggctacttcgacctgatgcacgtgcagaaggtgatgagcgccagcaccgtgtgcaagctgcagagctgcacccacggcgtgcccggcgacctgcagatctaccacgtgggcaacctgctgaagggcgacagagtgaacggccacctgatccacaaggtggagccccacctgaacaccagctggatgagctgggacggctgcgacctggactacttctgcaacatgggcgactggcccagctgcacctacaccggcgtgacccagcacaaccacgccgccttcgccaacctgctgaacatcgagaccgactacaccaagaccttccacttccacagcaagagagtgaccgcccacggcgacaccccccagctggacctgaaggccagacccagatacggcgccggcgagatcaccgtgctggtggaggtggccgacatggagctgcacaccaagaaggtggaggtgaccggcctgaagttcgccagcctgacctgcagcggctgctacgcctgcagcagcggcatcagctgcaaggtgagaatccacgtggacgagcccgacgagctgaccgtgcacgtgaagagcagcgaccccgacatcgtggccgccagcagcagcctgatggccagaaagatcgagttcggcgtggacagcaccttcaaggccttcagcagcatgcccaaggacagcctgtgcttctacatcgtggagagagactactgcaacagctgcaagaacgaggagacccagagatgcgtgaacgccaagctggagcagccccagagcatcctgatcgagcacaccggcaccatcatcggcaagcagaacgacacctgcggcagcagaaccagctgctggctggacagcttcaagagcttcttctacggcctgaagagcatgctgagcggcatcttcggcaacgtgttcctgggcatcttcctgttcctggcccccttcgccctgctgctgttcttcttcttcttcggctggagaatcctgttctgcttcaagtgctgcagaagaaccagaggcctgttcaagtacagacacatcaaggacgacgaggaggtgggctacaagaagatcatcgagagactgaacaacaagaagggcaagcacagactgctggacggcgagagactggccgacagaaagatcgccgagctgttcagcaccaagacccacatcggc

SEQ ID NO: 8936 - RNA, 2916 nt, synthetic construct
  misc_feature 1..2916: note = derived and/or modified CDS sequence (opt4) from CCHFV(ArD8194, Artificial)__DQ211626.1__Gn-4aa-Gc
  source 1..2916: mol_type = other RNA
gccgagggcggcagcaacgactgcgtgagcagaacccagctggtgaagaccgaggtggccgagatccacgaggacagctacggcggccccggcgagaagatcaccatctgcaacggcagcaccatcgtggaccagagactgggcagcgagctgggctgctacaccatcaacagagtgagaacctacaagctgtgcgagaacagcgccaccgagaagagctgcgagatcgacagcgtgcccgtgaagtgcaagcagggcttctgcctgaagatcacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacatccccctgctgggcagaaccgccatctacgtgtgcagaatgagcaaccaccccaagaccaccatggccttcctgttctggttcagcttcggctacgtgatcacctgcgtggtgtgcaaggtgctgttctacctgctgatcgtgatcggcaccctgggcaagagactgaagcagtacagagagctgaagccccagacctgcatcgtgtgcgagagcatccccgtgaacgccatcgacgccgagatgcacgacctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaaagctgctgcaggtgagcgagagcaccggcgtggccctgaagagaagctgctggatgatcaccctgctgatcctgctgaccgtgagcatgagccccgtgcagagcgcccccgtgggcagaaagcccctgttcctggacagaatcgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacaagggcaacaagatcctggtgagcggcagaagcgagagcatcatgaagctggaggagagaaccggcatcagctggtgcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgctggtgaagtggaaggtggagtacatcaagaccgaggccatcatctgcgtggagctgaccagccaggagagacagtgcagcctgatcgaggccggcaccagattcaacctgggccccgtgaccatcaccctgagcgagcccagaaacgtgcagcagagactgccccccgagatcatcaccctgcaccccaagatcgaggagggcttcttcgacctgatgcacgtgcagaaggtgatgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacctgaacaccagctggatgagctgggacggctgcgacctggactacttctgcaacatgggcgactggcccagctgcacctacaccggcgtgacccagcacaaccacgccgccttcatcaacatgctgaacatcgagaccgactacaccaagaccttccacttccacagcaagagagtgaccgcccacggcgacaccccccagctggacctgaaggccagacccgcctacggcgccggcgagatcaccgtgctggtggaggtggccgacctggagctgcacaccaagaagatcgaggtgagcggcctgaagttcgccagcctgagctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagagcggcgccgacagcaccttcaaggccttcagcagcatgcccaagaacagcctgtgcttctacatcgtggagagagactactgcagcagctgcaccgacgacgacacccagaagtgcgtggacatcaagctggagcacccccagagcatcctgatcgagcacaagggcaccatcatcggcaagcagaacgacacctgccccaccaagaccagctgctggctggagagcatcaagagcttcttctacggcctgaagaacatgctgagcggcatcttcggcaacgtgttcctgggcatgctgctgttcctggcccccttcatcctgctgatcctgttcttcttcttcggctggagactgctgttctgcctgaagtgctgcagaagaaccagaaagctgctgaagtacaagcacctgagagacgaggaggagagcggctacaagaagatcatcgagagactgaacgacaagaagggcaagagcagactgttcgacggcgagagactggccgacagaaagatcgccgagctgttcagcaccaagacccacatcggc

SEQ ID NO: 8937 - RNA, 2916 nt, synthetic construct
  misc_feature 1..2916: note = derived and/or modified CDS sequence (opt4) from CCHFV(ArD15786, Artificial)__DQ211627.1__Gn-4aa-Gc
  source 1..2916: mol_type = other RNA
gccgagggcggcagcaacgactgcgtgagcagaacccagctggtgaagaccgaggtgaccgagatccacgaggacagctacggcggccccggcgagaagatcaccatctgcaacggcagcaccatcgtggaccagagactgggcagcgagctgggctgctacaccatcaacagagtgagaacctacaagctgtgcgagaacagcgccaccgagaagagctgcgagatcgacagcgtgcccgtgaagtgcaagcagggcttctgcctgaagatcacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacatccccctgctgggccagaccgccatctacgtgtgcagaatgagcaaccaccccaagaccaccatggccttcctgttctggttcagcttcggctacgtgatcacctgcgtggtgtgcaaggtgctgttctacctgctgatcgtgatcggcaccctgggcaagagactgaagcagtacagagagctgaagccccagacctgcatcgtgtgcgagagcatccccgtgaacgccatcgacgccgagatgcacgacctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaaagctgctgcaggtgagcgagagcaccggcgtggccctgaagagaagctgctggatcatcaccctgctgatcctgctgaccgtgagcatgagccccgtgcagagcgcccccgtgggcagaaagcccctgagcctggacagcatcgccaagggcatgaagagcctgctgaacagcaccagcctggagaccagcctgagcatcgaggccccctggggcgccatcaacgtgcagagcaccttcaagcccaccatcagcgccgccaacatcgccctgagctggagcagcgtggagcacaagggcaacaagatcctggtgagcggcagaagcgagagcatcatgaagctggaggagagaaccggcatcagctggtgcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgctggtgaagtggaaggtggagtacatcaagaccgaggccatcatctgcgtggagctgaccagccaggagagacagtgcagcctgatcgaggccggcaccagattcaacctgggccccgtgaccatcaccctgagcgagcccagaaacgtgcagcagagactgccccccgagatcatcaccctgcaccccaagatcgaggagggcttcttcgacctgatgcacgtgcagaaggtgatgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacctgaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagagcggcgccgacagcaccttcaaggccttcagcagcatgcccaagaacagcctgtgcttctacatcgtggagagagactactgcagcagctgcaccgacgacgacacccagaagtgcgtggacatcaagctggagcacccccagagcatcctgatcgagcacaagggcaccatcatcggcaagcagaacgacacctgccccaccaagaccagctgctggctggagagcatcaagagcttcttctacggcctgaagaacatgctgagcggcatcttcggcaacatcttcctgggcatgctgctgttcctggcccccttcgtgctgctgatcctgttcttcttcttcggctggagactgctgttctgcctgaagtgctgcagaagaaccagaaagctgctgaagtacaagcacctgagagacgaggaggagagcggctacaagaagatcatcgagagactgaacgacaagaagggcaagagcagactgttcgacggcgagagactggccgacagaaagatcgccgagctgttcagcaccaagacccacgtgggc

SEQ ID NO: 8938 - RNA, 2916 nt, synthetic construct
  misc_feature 1..2916: note = derived and/or modified CDS sequence (opt4) from CCHFV(ArD39554, Artificial)__DQ211628.1__Gn-4aa-Gc
  source 1..2916: mol_type = other RNA
agcgagagcaacaacaacgactgcgtgagcagaacccagctgatcaagaccgagaacgccgagatccacggcgacgactacggcggccccggcgagaagatcaccatctgcaacggcagcaccatcgtggagcagagactgggcagcgagctgggctgctacaccatcaacagaatcaagagcttcaagctgtgcgagaacagcgccagcggcaagggctgcgagatcgacagcacccccgtgaagtgcaagcagggcttctgcctgaagatcacccaggagggcagaggccacgtgaagctgagcagaggcagcgagatcatcctggacgtgtgcgacagcagctgcgagatgatgatccccaagggcagcggcgacatcctggtggactgcagcggcggccagcagcacttcctgcaggacaacctggtggacctgggctgccccaacgtgcccctgctgggcaagatggccatctacatctgcagaatgagcaaccaccccaagaccaccatggccttcctgttctggttcagcttcggctacgtgatcacctgcatcttctgcaaggtgatcttctacgtgctgatcatcatcggcaccctgggcaagagaatcaagcagtacagagagctgaagccccagacctgcaccatctgcgaggccacccccgtgaacgccatcgacgccgagatgcacgacctgaactgcagctacaacatctgcccctactgcgccagcagactgaccagcgagggcctggtgagacacgtgacccagtgccccaagagaaaggagaagatcgaggagaccgagctgtacctgaacctggagagaatcccctggttcgtgagaaagctgctgcaggtgagcgagagcaccggcgtggccctgaagagaagcagctggctggtgaccctgctggtgctgctgaccgtgagcctgagccccgtgcagagcgcccccatcggcagaaagcccctgttcctggacagcaccgccaagagcatgaagagcctgctgaacagcaccagcctggagaccagcctgagcatcgaggccccctggggcgccatcaacgtgcagagcaccttcaagcccaccgccagcaccgccaacatcgccctgagctggagcagcgtggagcacagaggcaacaagatcctggtgaccggcagaagcgagagcatcatgaagctggaggagagaaccggcatcagctggaacctgggcgtggaggacgccagcgagagcaagaccctgaccgtgagcgtgatggacctgagccagatgtacagcaccgtgttcgagtacctgagcggcgacagacaggtggaggagtggcccaaggccacctgcaccggcgactgccccgagagatgcggctgcaccagcagcacctgcctgcacaaggcctggccccacagcagaaactggagatgcaaccccacctggtgctggggcgtgggcaccggctgcacctgctgcggcctggacgtgaagaacctgttcaccgactacatgctgatcaagtggaaggtggagttcatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagctggtgaccctgcaccccagagtggaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaagatcaacggcaacagcttccacaagatcgagcccaacctgaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgagaccccccagctggacctgaaggccagacccaagtacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgagactgcacgtggacgagcccgacgagctgaccgtgcacgtgaagagcgacgaccccgacgtggtggccgccagcagcagcctgatggccagaaagatcgagttcggcaccgacagcaccttcaaggccttcagcagcatgcccaaggacaagctgtgcttctacatcgtggagagagactactgcagcagctgcagcaaggaggacacccagaagtgcgtgaacgccaagctggagcagccccagagcatcctgatcgagcacaagggcaccatcatcggcaagcagaacgacacctgcaccgtgaaggccagctgctggctggagagcgtgaagagcttcttctacggcctgaagaacatgctgggcggcatcttcggcaacgtgatcctgggcatcatcatgttcctggcccccttcgccctgctgctgctgttcttcctgttcggctggagaatcctgttctgcctgagatgctgcagaagaaccagaggcctgttcaagtacaagcacatcaaggacgacgaggagagcggctacaagagaatcatcgagagactgaacaacaagaagggcaagaacaagctgttcgacggcgagagactggccgacaagaagatcgccgagctgttcagcaccaagacccacatcggc

SEQ ID NO: 8939 - RNA, 2916 nt, synthetic construct
  misc_feature 1..2916: note = derived and/or modified CDS sequence (opt4) from CCHFV(C-68031, Artificial)__DQ211629.1__Gn-4aa-Gc
  source 1..2916: mol_type = other RNA
agcgaggagagcggcgacgactgcatcagcagaacccagctgagcagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccatcaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggcagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8940 - RNA, 2916 nt, synthetic construct
  misc_feature 1..2916: note = derived and/or modified CDS sequence (opt4) from CCHFV(Drosdov, Artificial)__DQ211630.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcaccgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatgaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcaactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggtgtgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcatcttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8941 - RNA, 2916 nt, synthetic construct
  misc_feature 1..2916: note = derived and/or modified CDS sequence (opt4) from CCHFV(Kashmanov, Artificial)__DQ211631.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacagcctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8942 - RNA, 2916 nt, synthetic construct
  misc_feature 1..2916: note = derived and/or modified CDS sequence (opt4) from CCHFV(Oman, Artificial)__DQ211632.1__Gn-4aa-Gc
  source 1..2916: mol_type = other RNA
agcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggcagaaagcccctgttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8943 - RNA, 2916 nt, synthetic construct
  misc_feature 1..2916: note = derived and/or modified CDS sequence (opt4) from CCHFV(SPU97/85, Artificial)__DQ211633.1__Gn-4aa-Gc
  source 1..2916: mol_type = other RNA
agcgaggagagcgacggcgactgcatcagcagaacccagctgctgagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcagaatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggcagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacacccagaagtgcgtgaacaccaagctggagagaccccagagcatcctgatcgagcacaagggcaccatcatcggcaagcagaacgacacctgcaccgccaaggccagctgctggctggagagcgtgaagagcttcttctacggcctgaagagcatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggc

SEQ ID NO: 8944 - RNA, 2916 nt, synthetic construct
  misc_feature 1..2916: note = derived and/or modified CDS sequence (opt4) from CCHFV(SPU103/87, Artificial)__DQ211634.1__Gn-4aa-Gc
  source 1..2916: mol_type = other RNA
agcgaggagagcagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagaccttcaagctgtgcgagaacagcgccaccggcaagagctgcgagatcgacagcgtgcccgtgaagtgcagacagggctactgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcgtgctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaagactgctgcaggtgagcgagagcaccggcgtggccctgaagagaagcagctggctgatcgtgctgctggtgctgttcaccgtgagcctgagccccgtgcagagcgcccccatcagcagaagacccctgttcctggacaacatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaagatcgagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgcccagcgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctggtgcacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcaccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtgaacaccaagctggagcagccccagagcatcctgatcgagcacaagggcaccatcatcggcaagcagaacaacacctgcaaggccagagccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaagaatcgccgagctgttcagcaccaagacccacatcggc

SEQ ID NO: 8945 - RNA, 2916 nt, synthetic construct
  misc_feature 1..2916: note = derived and/or modified CDS sequence (opt4) from CCHFV(SPU415/85, Artificial)__DQ211635.1__Gn-4aa-Gc
  source 1..2916: mol_type = other RNA
agcgaggagagcgacggcgactgcatcagcagaacccagctgctgagaaccgagaccaccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcaactgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccatccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagagagtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgaagatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacaccagaaagtgcgtgaacaccaagctggacagaccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggc

SEQ ID NO: 8946 - RNA, 2916 nt, synthetic construct
  misc_feature 1..2916: note = derived and/or modified CDS sequence (opt4) from CCHFV(Turkey200310849, Artificial)__DQ211636.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcagctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccgccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggc

SEQ ID NO: 8947 - RNA, 2916 nt, synthetic construct
  misc_feature 1..2916: note = derived and/or modified CDS sequence (opt4) from CCHFV(Iran-52, Artificial)__DQ446215.1__Gn-4aa-Gc
  source 1..2916: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggcagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggaggagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8948 - RNA, 2916 nt, synthetic construct
  misc_feature 1..2916: note = derived and/or modified CDS sequence (opt4) from CCHFV(Iran-53, Artificial)__DQ446216.1__Gn-4aa-Gc
  source 1..2916: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggcagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8949 - RNA, 2916 nt, synthetic construct
  misc_feature 1..2916: note = derived and/or modified CDS sequence (opt4) from CCHFV(Kosova Hoti, Artificial)__EU037902.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccagaagggcagaggccacgtgaagctgagcagaggcagcgaggtggtgctggacgcctgcgacagcaactgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccaagaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgaagcagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgcccccagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccggcaccagcctgatggccagaaagctggagttcggcaccgacagcaccttcaaggccttcagcgccatgcccaagaccagcctgtgcttctacatcgtggagaaggagtactgcaagagctgcagcgaggacgacaccaagaagtgcgtggacaccaagctggagcagccccagagcatcctgatcgagcacagaggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8950 - RNA, 2916 nt, synthetic construct
  misc_feature 1..2916: note = derived and/or modified CDS sequence (opt4) from CCHFV(YL04057, Artificial)__FJ562094.1__Gn-4aa-Gc
  source 1..2916: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagagactgggcagagagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggcagaaagcccctgttcctggacagcatcgccaagggcaagaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcagccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccaggtgtaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcctgctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggc

SEQ ID NO: 8951 - RNA, 2916 nt, synthetic construct
  misc_feature 1..2916: note = derived and/or modified CDS sequence (opt4) from CCHFV(V42/81, Artificial)__GU477490.1__Gn-4aa-Gc
  source 1..2916: mol_type = other RNA
agcaaggagcccggcgacgactgcatcagcagaacccagctgatgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaaggcctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctggagtgcccccacatccccctgctgggcaagctggccatctacatctgcagaatgagcaaccaccccagaaccaccatggccttcctgttctggttcggcttcggctacgtgatcacctgcatcctgtgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggtgctgaagagaagcagctggctgatcgtgctgctggtgctgctgaccgtgagcctgagccccgtgcagagcgcccccgtgggcagaaagcccctgttcctggacagcatcgtgaagggcaagaagaacctgctgaacagcaccagcctggagaccagcctgagcatcgaggccccctggggcgccatcaacatccagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcatcgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgagaccccccagctggacctgaaggccagacccgcctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagagcggcaccgacagcaccttcaaggccttcagcgccatgcccaagaccagcctgtgcttctacatcgtggagagagagtactgcaagagctgcagcgaggacgacacccagaagtgcgtggagaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggaggacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8952 - RNA, 2916 nt, synthetic construct
  misc_feature 1..2916: note = derived and/or modified CDS sequence (opt4) from CCHFV(79121M18, Artificial)__GU477493.1__Gn-4aa-Gc
  source 1..2916: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagggcctgggcagcgagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggcagaaagcccctgttcctggacagcaccgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccagatctaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcttcctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggc

SEQ ID NO: 8953 - RNA, 2916 nt, synthetic construct
  misc_feature 1..2916: note = derived and/or modified CDS sequence (opt4) from CCHFV(Afg09-2990, Artificial)__HM452306.1__Gn-4aa-Gc
  source 1..2916: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcactacctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggcagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8954 - RNA, 2916 nt, synthetic construct
  misc_feature 1..2916: note = derived and/or modified CDS sequence (opt4) from CCHFV(Sudan Al-Fulah 3-2008, Artificial)__HQ378184.1__Gn-4aa-Gc
  source 1..2916: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgtgatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcagacagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggcagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagaaggagtactgcaagagctgcagcgaggaggacaccaagaagtgcgtgaacaccaagctggagcagccccagagcatcctgatcgagcacaagggcaccatcatcggcaagcagaacagcacctgcaccgccaaggtgagctgctggctggagagcgccaagagcttcttctacggcctgaaggacatgctgagcggcatcttcggcaacgtgttcatcggcatcttcctgttcctggcccccttcgtgctgctggtgctgttcttcatgttcggctggagaatcctgctgtgcttcagatgctgcagaagaaccagaggcctgttcaagtacagacacctgaaggacgacgaggagaccggctacagaagaatcatcgagagactgaacaacaagaagggcaagaacaagctgctggacggcgagagactggccgacagaaagatcgccgagctgttcagcaccaagacccacatcggc

SEQ ID NO: 8955 - RNA, 2916 nt, synthetic construct
  misc_feature 1..2916: note = derived and/or modified CDS sequence (opt4) from CCHFV(Sudan AB1-2009, Artificial)__HQ378187.1__Gn-4aa-Gc
  source 1..2916: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacctgatcacctgcatcctgtgcaaggccatcttctacctgctgatcatcatcggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggcagaaagcccctgttcctggacagcatcgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcaacgaggaggacaccaagaagtgcgtgaacaccaagctggagcagccccagagcatcctgatcgagcacaagggcaccatcatcggcaagcagaacagcacctgcaccgccagagccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8956 - RNA, 2916 nt, synthetic construct
  misc_feature 1..2916: note = derived and/or modified CDS sequence (opt4) from CCHFV(NIVA 118595, Artificial)__JN572083.1__Gn-4aa-Gc
  source 1..2916: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcatcgccctgaagagaagcagctggctgatcgtgctgctggtgctgttcaccgtgagcatcacccccgtgcagagcgcccccatcggcagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagagcggcaccgacagcaccttcaaggccttcagcgccatgcccaagaccagcctgtgcttctacatcgtggagagagagtactgcaagggctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcctgggcatcttcagcttcctggcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8957 - RNA, 2916 nt, synthetic construct
  misc_feature 1..2916: note = derived and/or modified CDS sequence (opt4) from CCHFV(NIV 112143, Artificial)__JN572085.1__Gn-4aa-Gc
  source 1..2916: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcatcgccctgaagagaagcagctggctgatcgtgctgctggtgctgttcaccgtgagcatcacccccgtgcagagcgcccccatcggcagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagggctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcctgggcatcttcagcttcctggcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8958 - RNA, 2916 nt, synthetic construct
  misc_feature 1..2916: note = derived and/or modified CDS sequence (opt4) from CCHFV(SCT ex Afghanistan, Artificial)__KC344856.1__Gn-4aa-Gc
  source 1..2916: mol_type = other RNA
agcgaggagagcggcgacgactgcatcagcagaacccagctgctgagaaccgagaccgccgaggtgcacaacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcaagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcttctgcaaggtgatcttctacctgctgatcgtggtgggcaccctgggcaagaagttcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggcagaaagcccctgttcctgaacagcatcgtgaagggcatgaagaacctgctgaacagcaccaacctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagagcctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaagctgaacggccacatgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgacatcagcggcctgaagttcgccagcctgacctgcgccggctgctacgcctgcagcagcggcatcagctgcaaggtgagaatccacgtggacgagcccgacgagctgaccgtgcacgtgaagagcgaggaccccgacatcgtggccgccagcaccagcctgatcgccagaaagctggagctgggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagggcatcctgatcgagcacaagggcaccatcatcggcaagcagaacgacacctgcaccgccaaggccggctgctggctggagagcgtgaagagcttcttctacggcctgaagaacatgctgagcggcatcttcggcaacgtgttcatcggcatcttcctgttcctggcccccttcgtgctgctgatcctgttcttcatgttcggctggagactgctgttctgcttcaagtgctgcagaagaaccagaggcctgttcaagtacagacacctgaaggaggacgaggagagcggctacagaagaatcatcgagagactgaacaacaagaagggcaagaacaagctgctggacggcgagagactggccgacagaagaatcgccgagctgttcagcaccaagacccacatcggc

SEQ ID NO: 8959 - RNA, 2916 nt, synthetic construct
  misc_feature 1..2916: note = derived and/or modified CDS sequence (opt4) from CCHFV(Zahedan 2007, Artificial)__KC867273.1__Gn-4aa-Gc
  source 1..2916: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggcttctgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggcagaagacccctgttcctggacagcatcgtgaaggacatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcttcttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8960 - RNA, 2916 nt, synthetic construct
  misc_feature 1..2916: note = derived and/or modified CDS sequence (opt4) from CCHFV(SPU 44/08, Artificial)__KJ682805.1__Gn-4aa-Gc
  source 1..2916: mol_type = other RNA
agcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcatcaagagcttcttctacggcctgaagaacatgctgagcggcatcttcggcaacgtgttcatcggcatcttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggc

SEQ ID NO: 8961 - RNA, 2916 nt, synthetic construct
  misc_feature 1..2916: note = derived and/or modified CDS sequence (opt4) from CCHFV(SPU 383/87, Artificial)__KJ682806.1__Gn-4aa-Gc
  source 1..2916: mol_type = other RNA
agcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctggtggtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatccagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcttcggcaagcagaacgacacctgcaccgccaaggccagctgctggctggagagcgtgaagagcttcttctacggcctgaagaacatgctgagcggcatcttcggcaacgtgttcatcggcgtgttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggc

SEQ ID NO: 8962 - RNA, 2916 nt, synthetic construct
  misc_feature 1..2916: note = derived and/or modified CDS sequence (opt4) from CCHFV(SPU 130/89, Artificial)__KJ682807.1__Gn-4aa-Gc
  source 1..2916: mol_type = other RNA
agcgaggagcccaactacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcagcagaaagcccctgagcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagcactgcaagagctgcagcaaggaggacacccagagatgcgtgaacaccaagctggagcagccccagagcatcctgatcgagcacaagggcaccatcatcggcaagcagaacgacacctgcaccgccaaggccagctgctggctggagagcatcaagagcttcttctacggcctgaagaacatgctgagcggcatcttcggcaacgtgttcatcggcgtgttcctgttcctggcccccttcatcatcctgatcctgttcttcatgttcggctggagaatcctgttctgcttcaagtgctgcagaagaaccagaggcctgctgaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggc

SEQ ID NO: 8963 - RNA, 2916 nt, synthetic construct
  misc_feature 1..2916: note = derived and/or modified CDS sequence (opt4) from CCHFV(SPU 497/88, Artificial)__KJ682808.1__Gn-4aa-Gc
  source 1..2916: mol_type = other RNA
agcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcaagggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggtgttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagcagaaagcccctgttcctggacagcatcgtgaagggcatgagaaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccagagccagctgctggctggagagcatcaagagcttcttctacggcctgaagaacatgctgagcggcatcttcggcaacgtgttcatcggcatcttcctgttcttcgcccccttcatcatgctgatcctgttcttcatgttcggctggagaatcctgttctgcttcaagtgctgcagaagaaccagaggcctgttcaagtacagacacctgaaggacgacgaggaggtgggctacagaaagatcatcgagagactgaacaacaagaagggcaagaacaagctgctggacggcgagagactggccgacagaaagatcgccgagctgttcagcaccaagacccacatcggc

SEQ ID NO: 8964 - RNA, 2916 nt, synthetic construct
  misc_feature 1..2916: note = derived and/or modified CDS sequence (opt4) from CCHFV(SPU 18/88, Artificial)__KJ682810.1__Gn-4aa-Gc
  source 1..2916: mol_type = other RNA
agcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatgggcttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagcagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccggcaaggccggctgctggctggagagcatcaagagcttcttctacggcctgaagaacatgctgagcggcatcttcggcaacgtgttcatcggcatcttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaagaacaagaagggcaagaacaagctgctggacggcgagagactggccgacagaaagatcgccgagctgttcagcaccaagacccacatcggc

SEQ ID NO: 8965 - RNA, 2916 nt, synthetic construct
  misc_feature 1..2916: note = derived and/or modified CDS sequence (opt4) from CCHFV(SPU 431/85, Artificial)__KJ682812.1__Gn-4aa-Gc
  source 1..2916: mol_type = other RNA
agcgaggagagcgacggcgactgcatcagcagaacccagctgctgagaaccgagaccaccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcaactgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccatccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggcagaaagcccctgttcctggacagcatcgtgaagggcagaaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagagagtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgaagatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacaccagaaagtgcgtgaacaccaagctggacagaccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggc

SEQ ID NO: 8966 - RNA, 2916 nt, synthetic construct
  misc_feature 1..2916: note = derived and/or modified CDS sequence (opt4) from CCHFV(SPU 48/90, Artificial)__KJ682813.1__Gn-4aa-Gc
  source 1..2916: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgtgatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaccaccaccatggccttcctgttctggttcagcttcggctacgtgatcacctgcatcctgtgcaaggccatcttctacctgctgatcatcatcggcaccctgggcaagagattcagacagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggcagaaagcccctgttcagagacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaacagagccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagaaggagtactgcaagagctgcagcgaggaggacaccaagaagtgcgtgaacaccaagctggagcagccccagagcatcctgatcgagcacaagggcaccatcatcggcaagcagaacagcacctgcaccgccaaggtgagctgctggctggagagcgccaagagcttcttctacggcctgaaggacatgctgagcggcatcttcggcaacgtgttcatcggcatcttcctgttcctggcccccttcatcctgctgatcctgttcttcatgttcggctggagaatcctgctgtgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8967 - RNA, 2916 nt, synthetic construct
  misc_feature 1..2916: note = derived and/or modified CDS sequence (opt4) from CCHFV(SPU 187/90, Artificial)__KJ682814.1__Gn-4aa-Gc
  source 1..2916: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggcagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcatcttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaagaccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8968 - RNA, 2916 nt, synthetic construct
  misc_feature 1..2916: note = derived and/or modified CDS sequence (opt4) from CCHFV(Haskovo-V46/13, Artificial)__KR092379.1__Gn-4aa-Gc
  source 1..2916: mol_type = other RNA
agcgaggagctgggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagaggcaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgcccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccggcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccaagctggagcagccccagagcatcctgatcgagcacaagggcaccatcatcggcaagcagaacgacacctgcaccgccagagccagctgctggctggagagcgtgaagagcttcttctacggcctgaagaacatgctgggcagcgtgttcggcaacttcctgatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8969 - RNA, 2916 nt, synthetic construct
  misc_feature 1..2916: note = derived and/or modified CDS sequence (opt4) from CCHFV(24-R-2012, Artificial)__KR814856.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8970 - RNA, 2916 nt, synthetic construct
  misc_feature 1..2916: note = derived and/or modified CDS sequence (opt4) from CCHFV(36-ST-2014, Artificial)__KR814857.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggaccagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgtgcggctggaagttcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagagccacatcggc

SEQ ID NO: 8971 - RNA, 2916 nt, synthetic construct
  misc_feature 1..2916: note = derived and/or modified CDS sequence (opt4) from CCHFV(37-R-2013, Artificial)__KR814858.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggacgacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgtgacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8972 - RNA, 2916 nt, synthetic construct
  misc_feature 1..2916: note = derived and/or modified CDS sequence (opt4) from CCHFV(44-ST-2010, Artificial)__KR814859.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgctgtggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggaccagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgtgcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagagccacatcggc

SEQ ID NO: 8973 - RNA, 2916 nt, synthetic construct
  misc_feature 1..2916: note = derived and/or modified CDS sequence (opt4) from CCHFV(46-ST-2012, Artificial)__KR814860.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8974 - RNA, 2916 nt, synthetic construct
  misc_feature 1..2916: note = derived and/or modified CDS sequence (opt4) from CCHFV(47-ST-2013, Artificial)__KR814861.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgagtgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8975 - RNA, 2916 nt, synthetic construct
  misc_feature 1..2916: note = derived and/or modified CDS sequence (opt4) from CCHFV(52-R-2014, Artificial)__KR814862.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacgtgcccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggacgacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccggctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8976 - RNA, 2916 nt, synthetic construct
  misc_feature 1..2916: note = derived and/or modified CDS sequence (opt4) from CCHFV(75-R-2012, Artificial)__KR814863.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcgcccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcctgtacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8977 - RNA, 2916 nt, synthetic construct
  misc_feature 1..2916: note = derived and/or modified CDS sequence (opt4) from CCHFV(75-ST-2010, Artificial)__KR814864.1__Gn-4aa-Gc
  source 1..2916: mol_type = other RNA
agcgaggagagcggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcctgttctgcaaggccctgttctacagcctgatcatcatcggcaccctgggcaagaagatcaagcagtacagagagctgagaccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagagccagaggcctgctgaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8978 - RNA, 2916 nt, synthetic construct
  misc_feature 1..2916: note = derived and/or modified CDS sequence (opt4) from CCHFV(3756-ST-2007, Artificial)__KR814866.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctgacccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8979 - RNA, 2916 nt, synthetic construct
  misc_feature 1..2916: note = derived and/or modified CDS sequence (opt4) from CCHFV(3809-ST-2007, Artificial)__KR814867.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcagaagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctgacccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8980 - RNA, 2916 nt, synthetic construct
  misc_feature 1..2916: note = derived and/or modified CDS sequence (opt4) from CCHFV(3820-ST-2007, Artificial)__KR814868.1__Gn-4aa-Gc
  source 1..2916: mol_type = other RNA
agcgaggagcccggcgacgactgcatcagcagaacccagctgctgaagaccgagaccgccgagatccacgacgacaactacggcagccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctggccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8981 - RNA, 2916 nt, synthetic construct
  misc_feature 1..2916: note = derived and/or modified CDS sequence (opt4) from CCHFV(4495-ST-2008, Artificial)__KR814869.1__Gn-4aa-Gc
  source 1..2916: mol_type = other RNA
agcgaggagagcggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcctgttctgcaaggccctgttctacagcctgatcatcatcggcaccctgggcaagaagatcaagcagtacagagagctgagaccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagagatgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagagccagaggcctgctgaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 8982 - RNA, 2916 nt, synthetic construct
  misc_feature 1..2916: note = derived and/or modified CDS sequence (opt4) from CCHFV(4691-ST-2009, Artificial)__KR814871.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccgccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8983 - RNA, 2916 nt, synthetic construct
  misc_feature 1..2916: note = derived and/or modified CDS sequence (opt4) from CCHFV(4701-ST-2009, Artificial)__KR814872.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcggcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8984 - RNA, 2916 nt, synthetic construct
  misc_feature 1..2916: note = derived and/or modified CDS sequence (opt4) from CCHFV(5170-R-2011, Artificial)__KR814873.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgagggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8985 - RNA, 2916 nt, synthetic construct
  misc_feature 1..2916: note = derived and/or modified CDS sequence (opt4) from CCHFV(Oman-199809166, Artificial)__KR864901.1__Gn-4aa-Gc
  source 1..2916: mol_type = other RNA
agcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggcagaaagcccctgttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 8986 - RNA, 2916 nt, synthetic construct
  misc_feature 1..2916: note = derived and/or modified CDS sequence (opt4) from CCHFV(200406546-Turkey, Artificial)__KR864902.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctgatcgacctgggctgcccccacgtgcccctgctgggcagaatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagttcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcatcgagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgaccgccagaaagctggagttcggcaccgacagcaccttcaaggccttcagcgccatgcccaagaccagcctgtgcttctacatcgtggagaaggagtactgcaagagctgcaacgaggacgacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacaagagaatcatcgagagactgaacaacaagaagggcaagaacagactgctggacggcgagagactggccgacagaaagatcgccgagctgttcagcaccaagacccacatcggc

SEQ ID NO: 8987 - RNA, 2916 nt, synthetic construct
  misc_feature 1..2916: note = derived and/or modified CDS sequence (opt4) from CCHFV(1-CR/HU-2015, Artificial)__KU161584.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8988 - RNA, 2916 nt, synthetic construct
  misc_feature 1..2916: note = derived and/or modified CDS sequence (opt4) from CCHFV(Gaib, Artificial)__KX013445.1__Gn-4aa-Gc
  source 1..2916: mol_type = other RNA
agcgaggagagcagcgacgactgcatcagcagaacccagctgctgagaaccgagaccgccgagatccacaacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcatccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcttctgcaaggccatcttctacctgctgatcatcgtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtggtgcactgccccaagagaaaggagaagatcgaggagaccgagctgtacctgaacctggagagagtgccctgggtggtgagaaagctgctgcaggtgagcgagagcaccggcgtggccctgaagagaagcagctggctgatcgtgctgctggtgctgctgaccgtgagcctgagccccgtgcagagcgcccccatcggcagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcatcgagcacagaggcaacaagatcctggtgagcggcagaagcgagagcatcatgaagctggaggagagaaccggcatcagctgggacctgggcgtggaggacgccagcgagagcagactgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcagagaggacacccagaagtgcgtgagcaccaagctggagcagccccagagcatcctgatcgagcacaagggcaccatcatcggcaagcagaacaacacctgcaccaccaagaccacctgctggctggagagcgtgaagagcttcttctacggcctgaagaacatgctgagcagcatcttcggcaacgtgttcgtgggcatcttcagcttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagagcaagctgctggacggcgagagactggccgacagaaagatcgccgagctgttcagcaccaagacccacatcggc

SEQ ID NO: 8989 - RNA, 2916 nt, synthetic construct
  misc_feature 1..2916: note = derived and/or modified CDS sequence (opt4) from CCHFV(Hodzha, Artificial)__KX013448.1__Gn-4aa-Gc
  source 1..2916: mol_type = other RNA
agcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagaatccccctgctgggcaagatggccatctacatctgcagaatgagcaaccaccccgagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgttcgccgtgagcctgagccccgtgcagagcgcccccatcggcagaagacccctgttcctggacagcatcgtgaagggcaagaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgcagcgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcagaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcaagtacaagcacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8990 - RNA, 2916 nt, synthetic construct
  misc_feature 1..2916: note = derived and/or modified CDS sequence (opt4) from CCHFV(IbAn7620, Artificial)__KX013451.1__Gn-4aa-Gc
  source 1..2916: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgagatcgtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggcagaaagcccctgttcctggacagcatcgccaagggcatgaagaaccccctgaacagcaccagcctggagaccagcctgagcatcgaggccccctggggcgccatcgacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccaacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8991 - RNA, 2916 nt, synthetic construct
  misc_feature 1..2916: note = derived and/or modified CDS sequence (opt4) from CCHFV(K128_76, Artificial)__KX013454.1__Gn-4aa-Gc
  source 1..2916: mol_type = other RNA
agcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcagcagaagacccctgttccaggacagcatcgtgaagggcatgaagaacctgctgaacagcaccagcctggagaccagcctgagcatcgaggccccctggggcgccatcaacgtgcagagcacctacaagcccgccgtgagcgccgccaacatcgccctgagctggagcagcgtggagcacagaggcagcaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggagaacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8992 - RNA, 2916 nt, synthetic construct
  misc_feature 1..2916: note = derived and/or modified CDS sequence (opt4) from CCHFV(K168_40, Artificial)__KX013457.1__Gn-4aa-Gc
  source 1..2916: mol_type = other RNA
agcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgaggtggacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcggcagaagacccctgttcctggacggcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcatcaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8993 - RNA, 2916 nt, synthetic construct
  misc_feature 1..2916: note = derived and/or modified CDS sequence (opt4) from CCHFV(K168_125, Artificial)__KX013460.1__Gn-4aa-Gc
  source 1..2916: mol_type = other RNA
agcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgaggtggacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaaggtgcccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcggcagaagacccctgttcctggacagcatcgtgaagggcaagaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcatcaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 8994 - RNA, 2916 nt, synthetic construct
  misc_feature 1..2916: note = derived and/or modified CDS sequence (opt4) from CCHFV(K229_194, Artificial)__KX013463.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaagggcaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacagctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggc

SEQ ID NO: 8995 - RNA, 2916 nt, synthetic construct
  misc_feature 1..2916: note = derived and/or modified CDS sequence (opt4) from CCHFV(K229_243, Artificial)__KX013466.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctgacccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 8996 - RNA, 2916 nt, synthetic construct
  misc_feature 1..2916: note = derived and/or modified CDS sequence (opt4) from CCHFV(K315_14, Artificial)__KX013469.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccgtggtggaccagagactgggcagcgagctgggctgctacaccatcaacagagtgaagagcttcaagctgtgcaagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgagggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaagctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8997 - RNA, 2916 nt, synthetic construct
  misc_feature 1..2916: note = derived and/or modified CDS sequence (opt4) from CCHFV(K323_27, Artificial)__KX013472.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacctgctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgaccgtgctgctggtgctgctgaccgtgagcctgagccccgtgcagagcgcccccgtgggcagaaagcccctgttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccggccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaacgacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8998 - RNA, 2916 nt, synthetic construct
  misc_feature 1..2916: note = derived and/or modified CDS sequence (opt4) from CCHFV(K340_6, Artificial)__KX013475.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcaccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatcccccccctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgagcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtgaccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacttcaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 8999 - RNA, 2916 nt, synthetic construct
  misc_feature 1..2916: note = derived and/or modified CDS sequence (opt4) from CCHFV(Mamon, Artificial)__KX013478.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgagcgacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccgtggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaagaccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9000 - RNA, 2916 nt, synthetic construct
  misc_feature 1..2916: note = derived and/or modified CDS sequence (opt4) from CCHFV(Min, Artificial)__KX013481.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcaccaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9001 - RNA, 2916 nt, synthetic construct
  misc_feature 1..2916: note = derived and/or modified CDS sequence (opt4) from CCHFV(Nakiwogo, Artificial)__KX013484.1__Gn-4aa-Gc
  source 1..2916: mol_type = other RNA
gccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcgtggtgtgcaaggtgctgttctacctgctgatcgtgatcggcaccctgggcaagaagctgaagcagtacagagagctgaagccccagacctgcatcgtgtgcgagagcatccccgtgaacgtgatcgacgccgagatgcacgagctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggcagaaagcccctgtacctggacagcatcgccaagggcatgaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacgtgcagcagagactgcccagcgagatcgtgaccctgcaccccaagatcgaggagggcttcttcgacctgatgcacgtgcagaaggtgctgttctgcaagcacagcctgcaggccaccagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcgtgaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagctgggcgccgacagcaccttcaaggccttcagcagcatgcccaagaacagcctgtgcttctacatcgtggagagagactactgcagcagctgcaccgacgacgacacccagaagtgcgtgaacaccaagctggagcacccccagagcatcctgatcgagcacaagggcaccatcatcggcaagcagaacgacacctgccccaccaagaccagctgctggctggagagcgtgaagagcttcttctacggcctgaagaacatgctgggcggcatcttcggcaacgtgttcctgggcatcttcctgttcctggcccccttcgccctgctgatcctgttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccgagctgttcagcaccaagacccacatcggc

SEQ ID NO: 9002 - RNA, 2916 nt, synthetic construct
  misc_feature 1..2916: note = derived and/or modified CDS sequence (opt4) from CCHFV(Saf, Artificial)__KX013487.1__Gn-4aa-Gc
  source 1..2916: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcactacctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacatgaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgtgagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9003 - RNA, 2916 nt, synthetic construct
  misc_feature 1..2916: note = derived and/or modified CDS sequence (opt4) from CCHFV(Ast199, Artificial)__KX056051.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagatgcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggc

SEQ ID NO: 9004 - RNA, 2916 nt, synthetic construct
  misc_feature 1..2916: note = derived and/or modified CDS sequence (opt4) from CCHFV(Ast149, Artificial)__KX056054.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggccctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggc

SEQ ID NO: 9005 - RNA, 2916 nt, synthetic construct
  misc_feature 1..2916: note = derived and/or modified CDS sequence (opt4) from CCHFV(Ast137, Artificial)__KX056057.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatccacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcatcgtgaagggcaccaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggc

SEQ ID NO: 9006 - RNA, 2916 nt, synthetic construct
  misc_feature 1..2916: note = derived and/or modified CDS sequence (opt4) from CCHFV(Ast133, Artificial)__KX056060.1__Gn-4aa-Gc
  source 1..2916: mol_type = other RNA
agcgaggagcccgacgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacctgctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcagcaagacccacatcggc

SEQ ID NO: 9007 - RNA, 2916 nt, synthetic construct
  misc_feature 1..2916: note = derived and/or modified CDS sequence (opt4) from CCHFV(SK/2015/human, Artificial)__KX458183.1__Gn-4aa-Gc
  source 1..2916: mol_type = other RNA
agcgaggagagcggcgacgactgcatcagcagaaccagactgctgagaaccgagaccgccgagatccacggcgacagctacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgagatgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaccatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggcagaagacccctgttcctggacagcatcgtgagaggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcgtgagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccagggcagacagtgcagcctgatcgaggccggcaccagattcaacctgggcagcgtgaccatcaccctgagcgagcccagaaacatccagcacaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacagaggcaccatcatcggcaagcagaacaacacctgcatcgccaaggccagctgctggctggagagcgtgaagagcttcttctacggcctgaagaacatgctgagcggcatcttcggcaacctgttcctgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9008 - RNA, 2916 nt, synthetic construct
  misc_feature 1..2916: note = derived and/or modified CDS sequence (opt4) from CCHFV(YL16070, Artificial)__KY354081.1__Gn-4aa-Gc
  source 1..2916: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagagactgggcagcgagctgggctgctacaccatcaacagagtgaagagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgtgtgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatgagccccgtgcagagcgcccccgtgggcagaaagcccctgttcctggacagcatcgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccaggtgtaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctgaagagcttcaagggcttcttctacggcctgaagaacatgctgagcggcatcttcggcaacgtgttcctgggcatcctgctgttcctggcccccttcgtgctgctgatcttcttcttcttcttcggctggagactgctgttctgcctgaagtgctgcaagaagaccaagggcctgctgaagtacaagcacctgaaggacaaggaggaggccggctacaagaagatcatcgagagactgaacggcaagaagggcaagagccagctgttcgacggcgagagactggccaacagaaagatcgccgagctgttcagcaccaagatccacatcggc

SEQ ID NO: 9009 - RNA, 2916 nt, synthetic construct
  misc_feature 1..2916: note = derived and/or modified CDS sequence (opt4) from CCHFV(Oman_812956, Artificial)__KY362518.1__Gn-4aa-Gc
  source 1..2916: mol_type = other RNA
agcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggcagaaagcccctgttcttcgacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 9010 - RNA, 2916 nt, synthetic construct
  misc_feature 1..2916: note = derived and/or modified CDS sequence (opt4) from CCHFV(UCCR4405, Artificial)__KY484029.1__Gn-4aa-Gc
  source 1..2916: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggcagaaagcccctgttcctggacagcaccgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcaactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggtgtgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcatcttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9011 - RNA, 2916 nt, synthetic construct
  misc_feature 1..2916: note = derived and/or modified CDS sequence (opt4) from CCHFV(UCCR4401, Artificial)__KY484035.1__Gn-4aa-Gc
  source 1..2916: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgagaagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggcagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacagaagaatcgccgagctgttcagcaccaagacccacatcggc

SEQ ID NO: 9012 - RNA, 2916 nt, synthetic construct
  misc_feature 1..2916: note = derived and/or modified CDS sequence (opt4) from CCHFV(UCCR4448, Artificial)__KY484042.1__Gn-4aa-Gc
  source 1..2916: mol_type = other RNA
agcgaggagaccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccatcagcctgagccccgtgcagagcgcccccatcagcagaaagcccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagaagaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagatcctggccgacagaagaatcgccgagctgttcagcaccaagacccacatcggc

SEQ ID NO: 9013 - RNA, 2916 nt, synthetic construct
  misc_feature 1..2916: note = derived and/or modified CDS sequence (opt4) from CCHFV(SPU 45/88, Artificial)__KJ682809.1__Gn-4aa-Gc
  source 1..2916: mol_type = other RNA
agcgaggagagcagcgacgactgcctgagcagaacccagctgctgagaaccgagaacaccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatgggcttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctggatcgtgagaaagctgctgcaggtgagcgagagcaccggcgtggccctgaagagaagcagctggctggtggtgctgctggtgctgctgaccgtgagcctgagccccgtgcagagcgcccccatcggcagaaagcccctgttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaacgtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcctgctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggc

SEQ ID NO: 9014 - RNA, 2916 nt, synthetic construct
  misc_feature 1..2916: note = derived and/or modified CDS sequence (opt4) from CCHFV(3010, Artificial)__DQ019222.1__Gn-4aa-Gc
  source 1..2916: mol_type = other RNA
gccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcatcgtgtgcaaggtgctgttctacctgctgatcgtgatcggcaccctgagcaagaagctgaagcagtacagagagctgaagccccagacctgcatcgtgtgcgagagcacccccgtgaacgccatcgacgccgagatgcacgagctgaactgcaactacaacatctgcccctactgcgccagcagactgaccagcgacggcctggtgagacacgtgaaccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggcagaagacccctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 9015 - RNA, 972 nt, synthetic construct
  misc_feature 1..972: note = derived and/or modified CDS sequence (opt4) from CCHFV(10200)__U39455.2__Gn
  source 1..972: mol_type = other RNA
agcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgagaagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggc

SEQ ID NO: 9016 - RNA, 972 nt, synthetic construct
  misc_feature 1..972: note = derived and/or modified CDS sequence (opt4) from CCHFV(IbAr10200)__AF467768.2__Gn
  source 1..972: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgagaagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggc

SEQ ID NO: 9017 - RNA, 972 nt, synthetic construct
  misc_feature 1..972: note = derived and/or modified CDS sequence (opt4) from CCHFV(Turkey-Kelkit06)__GQ337054.1__Gn
  source 1..972: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcagaatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9018 - RNA, 972 nt, synthetic construct
  misc_feature 1..972: note = derived and/or modified CDS sequence (opt4) from CCHFV(SR3)__AJ538199.1__Gn
  source 1..972: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggc

SEQ ID NO: 9019 - RNA, 972 nt, synthetic construct
  misc_feature 1..972: note = derived and/or modified CDS sequence (opt4) from CCHFV(UCCR4413)__KY484038.1__Gn
  source 1..972: mol_type = other RNA
agcgagagcagcgccagcggctgcatcagcagaacccagatgatcaagagcgagaccgccgagatccacgacgacatctacggcggccccggcgagaagctgaccatctgcaacggcaccaccgtggtggaccagagactgggcagcgagctgggctgctacaccatcaacagaatcaagacctacaagctgtgcgagaacagcgtgaaggagaagacctgcgagatcgacagcgtgcccgtgaagtgcagacagggcctgtgcctgaagatcacccaggagggcagaggccacgtgaagctgagcagaggcagcgagatcgtgctggacatctgcgacagcagctgcgagctgatgatccccaagggcaccggcgacatcctggtggactgcagcggcggccagcagcacttcctgcaggacaacctggtggacctgggctgccccaacatccccctgctgggcaaggtggccatctacatctgcagaatgagcaaccaccccaagaccaccatggccttcctgttctggttcagcttcggctacgtgatcacctgcatcctgtgcaagatcctgttctacctgctgatcatcaccggcaccctgggcaagaagctgaagcagtacagagagctgaagccccagacctgcaccatctgcgagagcacccccgtgaacgccatcgacgccgagatgcacgacctgaactgcagctacaacatctgcccctactgcgccagcagactgaccagcgacggcctgatcagacacgtgaacctgtgccccaagagaaaggagaaggtggaggagaccgagctgtacctgaacctggagagaatcccctggttcgtgagaaagctgctgcaggtgagcgagagcaccggcgtggccctgaagagaagcagctggctgctgatcctggtgatcctgctgaccgtgagcatgagccccgtgcagagcgcccccatcaac

SEQ ID NO: 9020 - RNA, 972 nt, synthetic construct
  misc_feature 1..972: note = derived and/or modified CDS sequence (opt4) from CCHFV(66019)__AB069669.1__Gn
  source 1..972: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccatcgtggaccagagactgggcagcgagctgggctgctacaccatcaacagagtgaagagcttcaagctgtgcgagaacagcggcaccggcaagagctgcaagatcgacaacacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcttctgcaagatcatcttctacctgctgatcgtggtgggcaccctgggcaagaagttcaagcagtacagagagctgaagccccagacctgcaccatctgcgagaccacccccaccaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggc

SEQ ID NO: 9021 - RNA, 972 nt, synthetic construct
  misc_feature 1..972: note = derived and/or modified CDS sequence (opt4) from CCHFV(7001)__AB069670.1__Gn
  source 1..972: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagagactgggcagcgagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggc

SEQ ID NO: 9022 - RNA, 972 nt, synthetic construct
  misc_feature 1..972: note = derived and/or modified CDS sequence (opt4) from CCHFV(75024)__AB069671.1__Gn
  source 1..972: mol_type = other RNA
agcgaggagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagcatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccatcagcctgagccccgtgcagagcgcccccatcggc

SEQ ID NO: 9023 - RNA, 972 nt, synthetic construct
  misc_feature 1..972: note = derived and/or modified CDS sequence (opt4) from CCHFV(7803)__AB069672.1__Gn
  source 1..972: mol_type = other RNA
agcgaggagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtgatcctggacgcctgcgacagcagctgcgaggtgatgatccccaagggcaccggcgacatcctggtggactgcagcggcggccagcagcacttcctgaaggacaacctgatcgacctgggctgccccagcatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccatcagcctgagccccgtgcagagcgcccccatcagc

SEQ ID NO: 9024 - RNA, 972 nt, synthetic construct
  misc_feature 1..972: note = derived and/or modified CDS sequence (opt4) from CCHFV(79121)__AB069673.1__Gn
  source 1..972: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagggcctgggcagcgagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggc

SEQ ID NO: 9025 - RNA, 972 nt, synthetic construct
  misc_feature 1..972: note = derived and/or modified CDS sequence (opt4) from CCHFV(8402)__AB069674.1__Gn
  source 1..972: mol_type = other RNA
agcgaggagagcggcgacgactgcatcagcagaacccagctgctgagaaccgagaccgccgagatccacaacgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggc

SEQ ID NO: 9026 - RNA, 972 nt, synthetic construct
  misc_feature 1..972: note = derived and/or modified CDS sequence (opt4) from CCHFV(88166)__AB069675.1__Gn
  source 1..972: mol_type = other RNA
agcgaggagagcggcgacgactgcatcagcagaacccagctgctgagaaccgagaccgccgagatccacagcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatgggcttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggc

SEQ ID NO: 9027 - RNA, 972 nt, synthetic construct
  misc_feature 1..972: note = derived and/or modified CDS sequence (opt4) from CCHFV(BA88166)__AF338470.1__Gn
  source 1..972: mol_type = other RNA
agcgaggagagcggcgacgactgcatcagcagaacccagctgctgagaaccgagaccgccgagatccacagcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatgggcttcctgttctggttcagcttcggctacgtggtgacctgcatcctgtgcaagggcatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggc

SEQ ID NO: 9028 - RNA, 972 nt, synthetic construct
  misc_feature 1..972: note = derived and/or modified CDS sequence (opt4) from CCHFV(BA66019)__AF350448.1__Gn
  source 1..972: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccatcgtggaccagagactgggcagcgagctgggctgctacaccatcaacagagtgaagagcttcaagctgtgcgagaacagcggcaccggcaagagctgcaagatcgacaagcaccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcttctgcaagatcatcttctacctgctgatcgtggtgggcaccctgggcaagaagttcaagcagtacagagagctgaagccccagacctgcaccatctgcgagaccacccccaccaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggc

SEQ ID NO: 9029 - RNA, 972 nt, synthetic construct
  misc_feature 1..972: note = derived and/or modified CDS sequence (opt4) from CCHFV(BA8402)__AF350449.1__Gn
  source 1..972: mol_type = other RNA
agcgaggagagcggcgacgactgcatcagcagaacccagctgctgagaaccgagaccgccgagatccacaacgacaactacggcggccccggcgacaagatcaccatctgcaacggcagcaccgtggtggaccagagactgggcagcgagctgggctgctacaccatcaacagagtgaacagcttcaacctgtgcgagaacaccgccaccggcaagagctgcgagatcgacagcacccccgtgaagtgcagacagggcttctgcctgaagatcacccaggagggcagaggccacgtgaagctgagcagaggcagcgaggtggtgctggacgcctgcgagagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtggtgacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagacccaccagcgacggcctggccagacacgtgatgcagtgccccaagagaaaggagaagatcgaggagaccgccctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggc

SEQ ID NO: 9030 - RNA, 972 nt, synthetic construct
  misc_feature 1..972: note = derived and/or modified CDS sequence (opt4) from CCHFV(Matin)__AF467769.2__Gn
  source 1..972: mol_type = other RNA
agcgaggagagcggcgacgactgcatcagcagaacccagctgctgagaaccgagaccgccgagatccacagcgacagctacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggtgttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggc

SEQ ID NO: 9031 - RNA, 972 nt, synthetic construct
  misc_feature 1..972: note = derived and/or modified CDS sequence (opt4) from CCHFV(Baghdad 12)__AJ538197.2__Gn
  source 1..972: mol_type = other RNA
agcgaggagagcggcgacgactgcatcagcagaaccagactgctgagaaccgagaccgccgagatccacggcgacagctacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcaagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctggccgtgagcagcagccccgtgcagagcgcccccatcggc

SEQ ID NO: 9032 - RNA, 972 nt, synthetic construct
  misc_feature 1..972: note = derived and/or modified CDS sequence (opt4) from CCHFV(VLG/TI29414)__AY179961.1__Gn
  source 1..972: mol_type = other RNA
agcgaggagcccggcgacgactgcatcagcagaacccagctgctgagagccgagcccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggaacgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9033 - RNA, 972 nt, synthetic construct
  misc_feature 1..972: note = derived and/or modified CDS sequence (opt4) from CCHFV(TADJ/HU8966)__AY179962.1__Gn
  source 1..972: mol_type = other RNA
agcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcagcgtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcaccagaatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagagagtggaggagaccgagctgtacctgaacctggagagaatcccctggatcgtgagaaagctgctgcaggtgagcgagagcaccggcgtggccctgaagagaagcagctggctgatcgtgctgctggtgctgttcaccgtgagcctgagccccgtgcagagcgcccccatcggc

SEQ ID NO: 9034 - RNA, 972 nt, synthetic construct
  misc_feature 1..972: note = derived and/or modified CDS sequence (opt4) from CCHFV(Hodzha)__AY223476.1__Gn
  source 1..972: mol_type = other RNA
agcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagagctgcgagatcgacagcacccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagaatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgttcgccgtgagcctgagccccgtgcagagcgcccccatcggc

SEQ ID NO: 9035 - RNA, 972 nt, synthetic construct
  misc_feature 1..972: note = derived and/or modified CDS sequence (opt4) from CCHFV(Kosovo/9553/2001)__AY675511.1__Gn
  source 1..972: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatcgccagaatgagcaaccaccccaagaccaccatggccttcctgttctggttcagcctgggctacgtgatcacctgcatcctgtgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgaagcagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9036 - RNA, 972 nt, synthetic construct
  misc_feature 1..972: note = derived and/or modified CDS sequence (opt4) from CCHFV(SPU41/84)__AY900142.1__Gn
  source 1..972: mol_type = other RNA
agcgaggagagcagcgacgactgcatcagcagaacccagctgctgagaaccgagaccgccgagatccacggcgacaactacggcggccccggcgacaagatcaccatctgcaacggcagcaccgtggtggaccagagactgggcagcgagctgggctgctacaccatcaacagagtgaagaccttcaagctgtgcgagaacagcgccaccggcaagagctgcgagatcgacagcgtgcccgtgaagtgcagacagggctactgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcatctgcaaggtgatcttctacctgctgatcatcgtgggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcagc

SEQ ID NO: 9037 - RNA, 972 nt, synthetic construct
  misc_feature 1..972: note = derived and/or modified CDS sequence (opt4) from CCHFV(UG3010)__AY900143.1__Gn
  source 1..972: mol_type = other RNA
gccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcatcgtgtgcaaggtgctgttctacctgctgatcgtgatcggcaccctgagcaagaagctgaagcagtacagagagctgaagccccagacctgcatcgtgtgcgagagcacccccgtgaacgccatcgacgccgagatgcacgagctgaactgcaactacaacatctgcccctactgcgccagcagactgaccagcgacggcctggtgagacacgtgaaccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggc

SEQ ID NO: 9038 - RNA, 972 nt, synthetic construct
  misc_feature 1..972: note = derived and/or modified CDS sequence (opt4) from CCHFV(Hy13)__AY900145.1__Gn
  source 1..972: mol_type = other RNA
agcgaggagagcggcgacgactgcatcagcagaacccagctgagcagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccatcaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcggc

SEQ ID NO: 9039 - RNA, 972 nt, synthetic construct
  misc_feature 1..972: note = derived and/or modified CDS sequence (opt4) from CCHFV(Semunya)__DQ094832.1__Gn
  source 1..972: mol_type = other RNA
gccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcgtggtgtgcaaggtgctgttctacctgctgatcgtgatcggcaccctgggcaagaagctgaagcagtacagagagctgaagccccagacctgcatcgtgtgcgagagcatccccgtgaacgccatcgacgccgagatgcacgagctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggc

SEQ ID NO: 9040 - RNA, 972 nt, synthetic construct
  misc_feature 1..972: note = derived and/or modified CDS sequence (opt4) from CCHFV(SPU128/81/7)__DQ157174.1__Gn
  source 1..972: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgagagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggc

SEQ ID NO: 9041 - RNA, 972 nt, synthetic construct
  misc_feature 1..972: note = derived and/or modified CDS sequence (opt4) from CCHFV(ROS/HUVLV-100)__DQ206448.1__Gn
  source 1..972: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9042 - RNA, 972 nt, synthetic construct
  misc_feature 1..972: note = derived and/or modified CDS sequence (opt4) from CCHFV(AP92)__DQ211625.1__Gn
  source 1..972: mol_type = other RNA
agcgagggcggcgacggcggctgcatcagcagaacccagctgatcaagaccgagaccgccgaggtgcacggcgacgactacggcggccccggcgagaagatcaccatctgcaacggcagcaccatcgtggaccagagactgggcagcgagctgggctgctacaccatcaacagaatcaagagcttcaagctgtgcgagaacagcgcccagggcaagaactgcgagatcgacagcgcccccgtgcagtgcagacagggctactgcctgaagatcagccaggagggcagaggccacgtgaagctgagcagaggcagcgagatcgtgctggacgtgtgcgacaccagctgcgagatcatgatccccaagggcaccggcgacatcctggtggactgcagcggcggccagcagcacttcctgcagagcaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaagaccctgttctacatcctgatcatcatcggcaccctgggcaagaagctgaagcagtacagagagctgaagccccagacctgcaccatctgcgagagcgtgcccgtgaacgccatcgacgccgagatgcacgacctgaactgcagctacaacatctgcccctactgcgccagcagactgaccagcgagggcctgaccagacacgtgaaccagtgccccaagagaaaggagaaggtggaggagaccgagctgtacctgaacctggagagaatcccctggatcgtgagaaagctgctgcaggtgagcgagagcaccggcgtggccctgaagagaagcagctggatgatcgtgctgctgatcctgctgatcgtgagcatgagccccgtgcagagcgcccccatcagc

SEQ ID NO: 9043 - RNA, 972 nt, synthetic construct
  misc_feature 1..972: note = derived and/or modified CDS sequence (opt4) from CCHFV(ArD8194)__DQ211626.1__Gn
  source 1..972: mol_type = other RNA
gccgagggcggcagcaacgactgcgtgagcagaacccagctggtgaagaccgaggtggccgagatccacgaggacagctacggcggccccggcgagaagatcaccatctgcaacggcagcaccatcgtggaccagagactgggcagcgagctgggctgctacaccatcaacagagtgagaacctacaagctgtgcgagaacagcgccaccgagaagagctgcgagatcgacagcgtgcccgtgaagtgcaagcagggcttctgcctgaagatcacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacatccccctgctgggcagaaccgccatctacgtgtgcagaatgagcaaccaccccaagaccaccatggccttcctgttctggttcagcttcggctacgtgatcacctgcgtggtgtgcaaggtgctgttctacctgctgatcgtgatcggcaccctgggcaagagactgaagcagtacagagagctgaagccccagacctgcatcgtgtgcgagagcatccccgtgaacgccatcgacgccgagatgcacgacctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaaagctgctgcaggtgagcgagagcaccggcgtggccctgaagagaagctgctggatgatcaccctgctgatcctgctgaccgtgagcatgagccccgtgcagagcgcccccgtgggc

SEQ ID NO: 9044 - RNA, 972 nt, synthetic construct
  misc_feature 1..972: note = derived and/or modified CDS sequence (opt4) from CCHFV(ArD15786)__DQ211627.1__Gn
  source 1..972: mol_type = other RNA
gccgagggcggcagcaacgactgcgtgagcagaacccagctggtgaagaccgaggtgaccgagatccacgaggacagctacggcggccccggcgagaagatcaccatctgcaacggcagcaccatcgtggaccagagactgggcagcgagctgggctgctacaccatcaacagagtgagaacctacaagctgtgcgagaacagcgccaccgagaagagctgcgagatcgacagcgtgcccgtgaagtgcaagcagggcttctgcctgaagatcacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacatccccctgctgggccagaccgccatctacgtgtgcagaatgagcaaccaccccaagaccaccatggccttcctgttctggttcagcttcggctacgtgatcacctgcgtggtgtgcaaggtgctgttctacctgctgatcgtgatcggcaccctgggcaagagactgaagcagtacagagagctgaagccccagacctgcatcgtgtgcgagagcatccccgtgaacgccatcgacgccgagatgcacgacctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaaagctgctgcaggtgagcgagagcaccggcgtggccctgaagagaagctgctggatcatcaccctgctgatcctgctgaccgtgagcatgagccccgtgcagagcgcccccgtgggc

SEQ ID NO: 9045 - RNA, 972 nt, synthetic construct
  misc_feature 1..972: note = derived and/or modified CDS sequence (opt4) from CCHFV(ArD39554)__DQ211628.1__Gn
  source 1..972: mol_type = other RNA
agcgagagcaacaacaacgactgcgtgagcagaacccagctgatcaagaccgagaacgccgagatccacggcgacgactacggcggccccggcgagaagatcaccatctgcaacggcagcaccatcgtggagcagagactgggcagcgagctgggctgctacaccatcaacagaatcaagagcttcaagctgtgcgagaacagcgccagcggcaagggctgcgagatcgacagcacccccgtgaagtgcaagcagggcttctgcctgaagatcacccaggagggcagaggccacgtgaagctgagcagaggcagcgagatcatcctggacgtgtgcgacagcagctgcgagatgatgatccccaagggcagcggcgacatcctggtggactgcagcggcggccagcagcacttcctgcaggacaacctggtggacctgggctgccccaacgtgcccctgctgggcaagatggccatctacatctgcagaatgagcaaccaccccaagaccaccatggccttcctgttctggttcagcttcggctacgtgatcacctgcatcttctgcaaggtgatcttctacgtgctgatcatcatcggcaccctgggcaagagaatcaagcagtacagagagctgaagccccagacctgcaccatctgcgaggccacccccgtgaacgccatcgacgccgagatgcacgacctgaactgcagctacaacatctgcccctactgcgccagcagactgaccagcgagggcctggtgagacacgtgacccagtgccccaagagaaaggagaagatcgaggagaccgagctgtacctgaacctggagagaatcccctggttcgtgagaaagctgctgcaggtgagcgagagcaccggcgtggccctgaagagaagcagctggctggtgaccctgctggtgctgctgaccgtgagcctgagccccgtgcagagcgcccccatcggc

SEQ ID NO: 9046 - RNA, 972 nt, synthetic construct
  misc_feature 1..972: note = derived and/or modified CDS sequence (opt4) from CCHFV(Drosdov)__DQ211630.1__Gn
  source 1..972: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaagtgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9047 - RNA, 972 nt, synthetic construct
  misc_feature 1..972: note = derived and/or modified CDS sequence (opt4) from CCHFV(Oman)__DQ211632.1__Gn
  source 1..972: mol_type = other RNA
agcgaggagagcggcgaggactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacaacacccccgtgaagtgcaagcagggcttctgcctgaagatcacccaggagggcagaggccacgtgaagctgagcagagacagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccatcggc

SEQ ID NO: 9048 - RNA, 972 nt, synthetic construct
  misc_feature 1..972: note = derived and/or modified CDS sequence (opt4) from CCHFV(SPU97/85)__DQ211633.1__Gn
  source 1..972: mol_type = other RNA
agcgaggagagcgacggcgactgcatcagcagaacccagctgctgagaaccgagaccgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcagaatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggc

SEQ ID NO: 9049 - RNA, 972 nt, synthetic construct
  misc_feature 1..972: note = derived and/or modified CDS sequence (opt4) from CCHFV(SPU103/87)__DQ211634.1__Gn
  source 1..972: mol_type = other RNA
agcgaggagagcagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagaccttcaagctgtgcgagaacagcgccaccggcaagagctgcgagatcgacagcgtgcccgtgaagtgcagacagggctactgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcgtgctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaagactgctgcaggtgagcgagagcaccggcgtggccctgaagagaagcagctggctgatcgtgctgctggtgctgttcaccgtgagcctgagccccgtgcagagcgcccccatcagc

SEQ ID NO: 9050 - RNA, 972 nt, synthetic construct
  misc_feature 1..972: note = derived and/or modified CDS sequence (opt4) from CCHFV(SPU415/85)__DQ211635.1__Gn
  source 1..972: mol_type = other RNA
agcgaggagagcgacggcgactgcatcagcagaacccagctgctgagaaccgagaccaccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggcttctgcctgaagatcacccaggagggcagaggccacgtgaagctgagcagaggcagcgagatcgtgctggacgcctgcgacagcaactgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggccggcaccgtgggcaagaagttcaagcagtacagagagctgagaccccagacctgcaccatctgcgagaccatccccgtgaacgccatcgacgccgagatgcacgacctgaactgcagctacaacatctgcccctactgcgccagcagactgaccagcgacggcctggccagacacgtgatgcagtgccccaagagaaaggagaaggtggaggagaccgagctgtacctgaacctggagagaatcccctgggtggtgagaaagctgctgcaggtgagcgagagcaccggcgtggccctgaagagaagcagctggctgaccgtgctgctggtgctgctgatcgtgagcctgagccccgtgcagagcgcccccatcggc

SEQ ID NO: 9051 - RNA, 972 nt, synthetic construct
  misc_feature 1..972: note = derived and/or modified CDS sequence (opt4) from CCHFV(Turkey200310849)__DQ211636.1__Gn
  source 1..972: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcagctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9052 - RNA, 972 nt, synthetic construct
  misc_feature 1..972: note = derived and/or modified CDS sequence (opt4) from CCHFV(Kosova Hoti)__EU037902.1__Gn
  source 1..972: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccagaagggcagaggccacgtgaagctgagcagaggcagcgaggtggtgctggacgcctgcgacagcaactgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccaagaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgaagcagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9053 - RNA, 972 nt, synthetic construct
  misc_feature 1..972: note = derived and/or modified CDS sequence (opt4) from CCHFV(YL04057)__FJ562094.1__Gn
  source 1..972: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagagactgggcagagagctgggctgctacaccatcaacagagtgagaagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgcctgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatcagccccgtgcagagcgcccccgtgggc

SEQ ID NO: 9054 - RNA, 972 nt, synthetic construct
  misc_feature 1..972: note = derived and/or modified CDS sequence (opt4) from CCHFV(V42/81)__GU477490.1__Gn
  source 1..972: mol_type = other RNA
agcaaggagcccggcgacgactgcatcagcagaacccagctgatgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaaggcctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctggagtgcccccacatccccctgctgggcaagctggccatctacatctgcagaatgagcaaccaccccagaaccaccatggccttcctgttctggttcggcttcggctacgtgatcacctgcatcctgtgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggtgctgaagagaagcagctggctgatcgtgctgctggtgctgctgaccgtgagcctgagccccgtgcagagcgcccccgtgggc

SEQ ID NO: 9055 - RNA, 972 nt, synthetic construct
  misc_feature 1..972: note = derived and/or modified CDS sequence (opt4) from CCHFV(Afg09-2990)__HM452306.1__Gn
  source 1..972: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggctactgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcactacctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggc

SEQ ID NO: 9056 - RNA, 972 nt, synthetic construct
  misc_feature 1..972: note = derived and/or modified CDS sequence (opt4) from CCHFV(Sudan Al-Fulah 3-2008)__HQ378184.1__Gn
  source 1..972: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgtgatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcagacagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggc

SEQ ID NO: 9057 - RNA, 972 nt, synthetic construct
  misc_feature 1..972: note = derived and/or modified CDS sequence (opt4) from CCHFV(Sudan AB1-2009)__HQ378187.1__Gn
  source 1..972: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacctgatcacctgcatcctgtgcaaggccatcttctacctgctgatcatcatcggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggc

SEQ ID NO: 9058 - RNA, 972 nt, synthetic construct
  misc_feature 1..972: note = derived and/or modified CDS sequence (opt4) from CCHFV(NIVA 118595)__JN572083.1__Gn
  source 1..972: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcatcgccctgaagagaagcagctggctgatcgtgctgctggtgctgttcaccgtgagcatcacccccgtgcagagcgcccccatcggc

SEQ ID NO: 9059 - RNA, 972 nt, synthetic construct
  misc_feature 1..972: note = derived and/or modified CDS sequence (opt4) from CCHFV(SCT ex Afghanistan)__KC344856.1__Gn
  source 1..972: mol_type = other RNA
agcgaggagagcggcgacgactgcatcagcagaacccagctgctgagaaccgagaccgccgaggtgcacaacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcaagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcttctgcaaggtgatcttctacctgctgatcgtggtgggcaccctgggcaagaagttcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccatcggc

SEQ ID NO: 9060 - RNA, 972 nt, synthetic construct
  misc_feature 1..972: note = derived and/or modified CDS sequence (opt4) from CCHFV(Zahedan 2007)__KC867273.1__Gn
  source 1..972: mol_type = other RNA
agcgaggagagcggcgacgactgcatcagcagaacccagctgctgagaaccgagaccgccgaggtgcacggcgacaactacggcggccccggcgacaagatcaccatctgcaacggcagcaccgtggtggaccagagactgggcagcgagctgggctgctacaccatcaacagagtgagaagcttcaagctgtgcgagaacagcgccaccggcaagagctgcgagatcgacagcatccccgtgaagtgcaagcagggcttctgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctggtggacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttcttcctgctgatcatcttcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccagaagaaaggagaaggtggaggagaccgagctgtacctgaacctggagagaatcccctgggtggtgagaaagctgctgcaggtgagcgagagcaccggcaccgtgctgaagagaagcagctggctgatcgtgctgctggtgctgttcaccgtgagcctgagccccgtgcagagcgcccccatcggc

SEQ ID NO: 9061 - RNA, 972 nt, synthetic construct
  misc_feature 1..972: note = derived and/or modified CDS sequence (opt4) from CCHFV(SPU 44/08)__KJ682805.1__Gn
  source 1..972: mol_type = other RNA
agcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagc

SEQ ID NO: 9062 - RNA, 972 nt, synthetic construct
  misc_feature 1..972: note = derived and/or modified CDS sequence (opt4) from CCHFV(SPU 383/87)__KJ682806.1__Gn
  source 1..972: mol_type = other RNA
agcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctggtggtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatccagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagc

SEQ ID NO: 9063 - RNA, 972 nt, synthetic construct
  misc_feature 1..972: note = derived and/or modified CDS sequence (opt4) from CCHFV(SPU 130/89)__KJ682807.1__Gn
  source 1..972: mol_type = other RNA
agcgaggagcccaactacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggccttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtggtgctgctggtgctgctgaccgtgagcctgagccccgtgcagagcgcccccatcagc

SEQ ID NO: 9064 - RNA, 972 nt, synthetic construct
  misc_feature 1..972: note = derived and/or modified CDS sequence (opt4) from CCHFV(SPU 497/88)__KJ682808.1__Gn
  source 1..972: mol_type = other RNA
agcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcaagggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatggtgttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagc

SEQ ID NO: 9065 - RNA, 972 nt, synthetic construct
  misc_feature 1..972: note = derived and/or modified CDS sequence (opt4) from CCHFV(SPU 18/88)__KJ682810.1__Gn
  source 1..972: mol_type = other RNA
agcgaggagagcaacgacgactgcctgagcagaacccagctgctgagaaccgagaacgccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatgggcttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccaaccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctgggtggtgagaaagctgctgcaggtgagcgagagcaccggcgtggccctgaagagaagcagctggctggtgatcctgctggtgctgctgaccgtgagcctgagccccgtgcagagcgcccccatcagc

SEQ ID NO: 9066 - RNA, 972 nt, synthetic construct
  misc_feature 1..972: note = derived and/or modified CDS sequence (opt4) from CCHFV(SPU 48/90)__KJ682813.1__Gn
  source 1..972: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgtgatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaccaccaccatggccttcctgttctggttcagcttcggctacgtgatcacctgcatcctgtgcaaggccatcttctacctgctgatcatcatcggcaccctgggcaagagattcagacagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggc

SEQ ID NO: 9067 - RNA, 972 nt, synthetic construct
  misc_feature 1..972: note = derived and/or modified CDS sequence (opt4) from CCHFV(SPU 187/90)__KJ682814.1__Gn
  source 1..972: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggc

SEQ ID NO: 9068 - RNA, 972 nt, synthetic construct
  misc_feature 1..972: note = derived and/or modified CDS sequence (opt4) from CCHFV(Haskovo-V46/13)__KR092379.1__Gn
  source 1..972: mol_type = other RNA
agcgaggagctgggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagaggcaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgcccgtgagcctgagccccgtgcagagcgcccccgtgggc

SEQ ID NO: 9069 - RNA, 972 nt, synthetic construct
  misc_feature 1..972: note = derived and/or modified CDS sequence (opt4) from CCHFV(24-R-2012)__KR814856.1__Gn
  source 1..972: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9070 - RNA, 972 nt, synthetic construct
  misc_feature 1..972: note = derived and/or modified CDS sequence (opt4) from CCHFV(36-ST-2014)__KR814857.1__Gn
  source 1..972: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9071 - RNA, 972 nt, synthetic construct
  misc_feature 1..972: note = derived and/or modified CDS sequence (opt4) from CCHFV(44-ST-2010)__KR814859.1__Gn
  source 1..972: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgctgtggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9072 - RNA, 972 nt, synthetic construct
  misc_feature 1..972: note = derived and/or modified CDS sequence (opt4) from CCHFV(47-ST-2013)__KR814861.1__Gn
  source 1..972: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcaagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9073 - RNA, 972 nt, synthetic construct
  misc_feature 1..972: note = derived and/or modified CDS sequence (opt4) from CCHFV(52-R-2014)__KR814862.1__Gn
  source 1..972: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacaccagctgcgaggtgatgatccccaagggcaccggcgacatcctggtggactgcagcggcggccagcagcacttcctgaaggacaacctgatcgacctgggctgcccccacgtgcccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9074 - RNA, 972 nt, synthetic construct
  misc_feature 1..972: note = derived and/or modified CDS sequence (opt4) from CCHFV(75-R-2012)__KR814863.1__Gn
  source 1..972: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcgcccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9075 - RNA, 972 nt, synthetic construct
  misc_feature 1..972: note = derived and/or modified CDS sequence (opt4) from CCHFV(75-ST-2010)__KR814864.1__Gn
  source 1..972: mol_type = other RNA
agcgaggagagcggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcctgttctgcaaggccctgttctacagcctgatcatcatcggcaccctgggcaagaagatcaagcagtacagagagctgagaccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9076 - RNA, 972 nt, synthetic construct
  misc_feature 1..972: note = derived and/or modified CDS sequence (opt4) from CCHFV(3820-ST-2007)__KR814868.1__Gn
  source 1..972: mol_type = other RNA
agcgaggagcccggcgacgactgcatcagcagaacccagctgctgaagaccgagaccgccgagatccacgacgacaactacggcagccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctggccgtgagcctgagccccgtgcagagcgcccccgtgggc

SEQ ID NO: 9077 - RNA, 972 nt, synthetic construct
  misc_feature 1..972: note = derived and/or modified CDS sequence (opt4) from CCHFV(4701-ST-2009)__KR814872.1__Gn
  source 1..972: mol_type = other RNA
agcgaggagcccggcgacgactgcatcagcagaacccagctgctgaagaccgagaccgccgagatccacgacgacaactacggcggccccggcgacaagatcaccatctgcaacggcagcaccgtggtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9078 - RNA, 972 nt, synthetic construct
  misc_feature 1..972: note = derived and/or modified CDS sequence (opt4) from CCHFV(5170-R-2011)__KR814873.1__Gn
  source 1..972: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgagggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9079 - RNA, 972 nt, synthetic construct
  misc_feature 1..972: note = derived and/or modified CDS sequence (opt4) from CCHFV(200406546-Turkey)__KR864902.1__Gn
  source 1..972: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgaggtgatgatccccaagggcaccggcgacatcctggtggactgcagcggcggccagcagcacttcctgaaggacaacctgatcgacctgggctgcccccacgtgcccctgctgggcagaatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagttcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9080 - RNA, 972 nt, synthetic construct
  misc_feature 1..972: note = derived and/or modified CDS sequence (opt4) from CCHFV(1-CR/HU-2015)__KU161584.1__Gn
  source 1..972: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9081 - RNA, 972 nt, synthetic construct
  misc_feature 1..972: note = derived and/or modified CDS sequence (opt4) from CCHFV(Gaib)__KX013445.1__Gn
  source 1..972: mol_type = other RNA
agcgaggagagcagcgacgactgcatcagcagaacccagctgctgagaaccgagaccgccgagatccacaacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcatccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcttctgcaaggccatcttctacctgctgatcatcgtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtggtgcactgccccaagagaaaggagaagatcgaggagaccgagctgtacctgaacctggagagagtgccctgggtggtgagaaagctgctgcaggtgagcgagagcaccggcgtggccctgaagagaagcagctggctgatcgtgctgctggtgctgctgaccgtgagcctgagccccgtgcagagcgcccccatcggc

SEQ ID NO: 9082 - RNA, 972 nt, synthetic construct
  misc_feature 1..972: note = derived and/or modified CDS sequence (opt4) from CCHFV(Hodzha)__KX013448.1__Gn
  source 1..972: mol_type = other RNA
agcgaggagagcggcgacgactgcatcagcagaacccagctgctgagaaccgagaccgccgagatccacggcgacgactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccagaatccccctgctgggcaagatggccatctacatctgcagaatgagcaaccaccccgagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgttcgccgtgagcctgagccccgtgcagagcgcccccatcggc

SEQ ID NO: 9083 - RNA, 972 nt, synthetic construct
  misc_feature 1..972: note = derived and/or modified CDS sequence (opt4) from CCHFV(IbAn7620)__KX013451.1__Gn
  source 1..972: mol_type = other RNA
agcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgagatcgtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggc

SEQ ID NO: 9084 - RNA, 972 nt, synthetic construct
  misc_feature 1..972: note = derived and/or modified CDS sequence (opt4) from CCHFV(K128_76)__KX013454.1__Gn
  source 1..972: mol_type = other RNA
agcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcagc

SEQ ID NO: 9085 - RNA, 972 nt, synthetic construct
  misc_feature 1..972: note = derived and/or modified CDS sequence (opt4) from CCHFV(K168_40)__KX013457.1__Gn
  source 1..972: mol_type = other RNA
agcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgaggtggacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcggc

SEQ ID NO: 9086 - RNA, 972 nt, synthetic construct
  misc_feature 1..972: note = derived and/or modified CDS sequence (opt4) from CCHFV(K168_125)__KX013460.1__Gn
  source 1..972: mol_type = other RNA
agcgacgagagcggcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgaggtggacagcatccccgtgaagtgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaaggtgcccctgctgggcaagatggccatctacatctgcagaatgagcaaccaccccaagaccaccatggccttcctgttctggttcagcttcggctacgtgatcacctgcatcgtgtgcaaggccatcttctacctgctgatcatcgtgggcaccctgggcaagagattcaagcagtacagagagctgaagccccagacctgcaccatctgcgagaccacccccaccaacgccatcgacgccgagatgcacgacctgaactgcagctacaacatctgcccctactgcgccagcagactgaccagcgacggcctggccagacacgtgacccactgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcgccgtgagcctgagccccgtgcagagcgcccccatcggc

SEQ ID NO: 9087 - RNA, 972 nt, synthetic construct
  misc_feature 1..972: note = derived and/or modified CDS sequence (opt4) from CCHFV(K229_194)__KX013463.1__Gn
  source 1..972: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaagggcaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9088 - RNA, 972 nt, synthetic construct
  misc_feature 1..972: note = derived and/or modified CDS sequence (opt4) from CCHFV(K315_14)__KX013469.1__Gn
  source 1..972: mol_type = other RNA
agcgaggagcccggcgacgactgcatcagcagaacccagctgctgaagaccgagaccgccgagatccacgacgacaactacggcggccccggcgacaagatcaccatctgcaacggcagcaccgtggtggaccagagactgggcagcgagctgggctgctacaccatcaacagagtgaagagcttcaagctgtgcaagaacagcgccaccggcaagacctgcgagatcgacagcacccccgtgaagtgcagacagggcttctgcctgaagatcacccaggagggcagaggccacgtgaagctgagcagaggcagcgaggtggtgctggacgtgtgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgagggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9089 - RNA, 972 nt, synthetic construct
  misc_feature 1..972: note = derived and/or modified CDS sequence (opt4) from CCHFV(K323_27)__KX013472.1__Gn
  source 1..972: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacctgctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgaccgtgctgctggtgctgctgaccgtgagcctgagccccgtgcagagcgcccccgtgggc

SEQ ID NO: 9090 - RNA, 972 nt, synthetic construct
  misc_feature 1..972: note = derived and/or modified CDS sequence (opt4) from CCHFV(K340_6)__KX013475.1__Gn
  source 1..972: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcaccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatcccccccctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9091 - RNA, 972 nt, synthetic construct
  misc_feature 1..972: note = derived and/or modified CDS sequence (opt4) from CCHFV(Mamon)__KX013478.1__Gn
  source 1..972: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgagcgacgcctgcgacagcagctgcgaggtgatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccgtggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9092 - RNA, 972 nt, synthetic construct
  misc_feature 1..972: note = derived and/or modified CDS sequence (opt4) from CCHFV(Nakiwogo)__KX013484.1__Gn
  source 1..972: mol_type = other RNA
gccgagggcgtgagcaacgactgcgtgagcagaacccagctgatcaagaccgaggtggccgagatccacgaggacagctacggcggccccggcgagaagatcaccatctgcaacggcagcaccatcgtggaccagagactgggcagcgagctgggctgctacaccatcaacagagtgaagacctacaagctgtgcgagaacagcgccaccgagaagggctgcgagatcgacagcgtgcccgtgaagtgcaagcagggcttctgcctgaaggtgacccaggagggcagaggccacgtgaagctgagcagaggcaccgagatcgtgctggacgtgtgcgacaccagctgcgagctgatgatccccaagggcaccggcgacatcctggtggactgcagcggcggccagcagcacttcctgcaggacaacctgatcgacctgggctgccccaacgtgcccctgctgggcaagatggccatctacatctgcagaatgagcaaccaccccaagaccaccatggccttcctgttctggttcagcttcggctacgtgatcacctgcgtggtgtgcaaggtgctgttctacctgctgatcgtgatcggcaccctgggcaagaagctgaagcagtacagagagctgaagccccagacctgcatcgtgtgcgagagcatccccgtgaacgtgatcgacgccgagatgcacgagctgaactgcaactacaacatctgcccctactgcgccagcagactgaccagcgacggcctggtgagacacgtgacccagtgccccaagagaaaggagaaggtggaggagaccgagctgtacctgaacctggagagaatcccctggctggtgagaagactgctgcaggtgagcgagagcaccggcatggccctgaagagaagctgctggatgaccaccctgctgatcctgctggtggtgagcctgagccccgtgcagagcgcccccgtgggc

SEQ ID NO: 9093 - RNA, 972 nt, synthetic construct
  misc_feature 1..972: note = derived and/or modified CDS sequence (opt4) from CCHFV(Saf)__KX013487.1__Gn
  source 1..972: mol_type = other RNA
agcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcactacctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgccccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9094 - RNA, 972 nt, synthetic construct
  misc_feature 1..972: note = derived and/or modified CDS sequence (opt4) from CCHFV(Ast199)__KX056051.1__Gn
  source 1..972: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagatgcagctggctgatcgtgctgctggtgctgctgaccgtgagcctgagccccgtgcagagcgcccccgtgggc

SEQ ID NO: 9095 - RNA, 972 nt, synthetic construct
  misc_feature 1..972: note = derived and/or modified CDS sequence (opt4) from CCHFV(Ast137)__KX056057.1__Gn
  source 1..972: mol_type = other RNA
agcgaggagcccggcgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatccacatctgcagaatgagcaaccaccccagaaccaccatggccttcctgttctggttcagcttcggctacgtgatcacctgcatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9096 - RNA, 972 nt, synthetic construct
  misc_feature 1..972: note = derived and/or modified CDS sequence (opt4) from CCHFV(Ast133)__KX056060.1__Gn
  source 1..972: mol_type = other RNA
agcgaggagcccgacgacgactgcatcagcagaacccagctgctgaagaccgagaccgccgagatccacgacgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagacctgcgagatcgacagcacccccgtgaagtgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctgatcgacctgggctgcccccacatccccctgctgggcaagatggccatctacatctgcagaatgagcaaccaccccagaaccaccatggccttcctgttctggttcagcttcggctacgtgatcacctgcatcttctgcaaggccctgttctacctgctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtgagcgagagcaccggcgtggccctgaagagaagcagctggctgatcgtgctgctggtgctgctgaccgtgagcctgagccccgtgcagagcgcccccgtgggc

SEQ ID NO: 9097 - RNA, 972 nt, synthetic construct
  misc_feature 1..972: note = derived and/or modified CDS sequence (opt4) from CCHFV(SK/2015/human)__KX458183.1__Gn
  source 1..972: mol_type = other RNA
agcgaggagagcggcgacgactgcatcagcagaaccagactgctgagaaccgagaccgccgagatccacggcgacagctacggcggccccggcgacaagatcaccatctgcaacggcagcaccatcgtggaccagagactgggcagcgagatgggctgctacaccatcaacagagtgaagagcttcaagctgtgcgagaacagcgccaccggcaagagctgcgagatcgacagcatccccgtgagatgcagacagggctactgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgccccaacatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcgtgggcaccctgggcaagagattcaagcagtacagagagctgaagccccagacctgcaccatctgcgagaccacccccgccaacgccatcgacgccgagatgcacgacctgaactgcagctacaccatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccgtgagcctgagccccgtgcagagcgcccccatcggc

SEQ ID NO: 9098 - RNA, 972 nt, synthetic construct
  misc_feature 1..972: note = derived and/or modified CDS sequence (opt4) from CCHFV(YL16070)__KY354081.1__Gn
  source 1..972: mol_type = other RNA
gccgagggcggcagcagcgactgcatcagcagaacccagctggtgaagaccgaggtggccgagatccacgaggacagctacggcggccccggcgagaagatcaccatctgcaacggcagcaccatcgtggaccagagactgggcagcgagctgggctgctacaccatcaacagagtgaagagctacaagctgtgcgagaacagcgccagcggcaagagctgcgagatcgacagcatccccgtgaagtgcaagcagggcttctgcctgaagatcacccaggagggcagaggccacgtgaagctgagcagaggcaccgagatcgtgctggacgtgtgcgacagcagctgcgagctgatgatccccaagggcaccggcgacatcctggtggactgcagcggcggccagcagcacttcctgcagaacaacctgatcgacctgggctgccccaacgtgcccctgctgggcaagatggccatctacgtgtgcagaatgagcaaccaccccaagaccaccatggccttcctgttctggttcagcttcggctacgtgatcacctgcatcgtgtgcagagtgctgttctacctgctgatcgccatcggcaccgtgggcaagaagctgaagcagtacagagagctgaagccccagacctgcatcgtgtgcgagagcgtgcccgtgaacgccatcgacgccgagatgcacgagctgaactgcagctacaacatctgcccctactgcgccagcagactgagcaccgacggcctgatcagacacgtgacccagtgccccaagagaagagagaaggtggaggagaccgagctgttcctgaacctggagagaatcccctggctggtgagaaagctgctgcaggtgagcgagagcaccggcatggccctgaagagaagctgctggatgatcaccctgctgatcctgctgctggtgagcatgagccccgtgcagagcgcccccgtgggc

SEQ ID NO: 9099 - RNA, 972 nt, synthetic construct
  misc_feature 1..972: note = derived and/or modified CDS sequence (opt4) from CCHFV(UCCR4448)__KY484042.1__Gn
  source 1..972: mol_type = other RNA
agcgaggagaccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgcatcctgtgcaaggccatcttctacctgctgatcatcatcggcaccctgggcaagagattcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctgggtggtgagaaagctgctgcaggtgagcgagagcaccggcgtggccctgaagagaagcagctggctgatcgtgctgctggtgctgttcaccatcagcctgagccccgtgcagagcgcccccatcagc

SEQ ID NO: 9100 - RNA, 972 nt, synthetic construct
  misc_feature 1..972: note = derived and/or modified CDS sequence (opt4) from CCHFV(SPU 45/88)__KJ682809.1__Gn
  source 1..972: mol_type = other RNA
agcgaggagagcagcgacgactgcctgagcagaacccagctgctgagaaccgagaacaccgagatccacagcgacaactacggcggccccggcgacaagatcaccatctgcaacggcagcaccatcgtggaccagagactgggcagcgagctgggctgctacaccatcaacagagtgaagagcttcaagctgtgcgagaacagcgccaccggcaagagctgcgagatcgacagcacccccgtgagatgcagacagggcttctgcctgaagatcacccaggagggcagaggccacgtgaagctgagcagaggcagcgaggtggtgctggacgcctgcgacagcagctgcgagatcatgatccccaagggcaccggcgacatcctggtggactgcagcggcggccagcagcacttcctgaaggacaacctggtggacctgggctgccccaacatccccctgctgggcaagatggccatctacatctgcagaatgagcaaccaccccaagaccaccatgggcttcctgttctggttcagcttcggctacgtgatcacctgcatcctgtgcaaggtgatcttctacctgctgatcgtggtgggcaccctgggcaagaagttcaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatgcagtgccccaagagaaaggagaagatcgaggagaccgagctgtacctgaacctggagagaatcccctggatcgtgagaaagctgctgcaggtgagcgagagcaccggcgtggccctgaagagaagcagctggctggtggtgctgctggtgctgctgaccgtgagcctgagccccgtgcagagcgcccccatcggc

SEQ ID NO: 9101 - RNA, 1932 nt, synthetic construct
  misc_feature 1..1932: note = derived and/or modified CDS sequence (opt4) from CCHFV(10200)__U39455.2__Gc
  source 1..1932: mol_type = other RNA
ttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggc

SEQ ID NO: 9102 - RNA, 1932 nt, synthetic construct
  misc_feature 1..1932: note = derived and/or modified CDS sequence (opt4) from CCHFV(IbAr10200)__AF467768.2__Gc
  source 1..1932: mol_type = other RNA
ttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtgggcgagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacagaagaatcgccgagctgttcagcaccaagacccacatcggc

SEQ ID NO: 9103 - RNA, 1932 nt, synthetic construct
  misc_feature 1..1932: note = derived and/or modified CDS sequence (opt4) from CCHFV(Turkey-Kelkit06)__GQ337054.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggtgcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggagccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggccctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcggcatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggc

SEQ ID NO: 9104 - RNA, 1935 nt, synthetic construct
  misc_feature 1..1935: note = derived and/or modified CDS sequence (opt4) from CCHFV(SR3)__AJ538199.1__Gc
  source 1..1935: mol_type = other RNA
ctgttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcaacaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 9105 - RNA, 1935 nt, synthetic construct
  misc_feature 1..1935: note = derived and/or modified CDS sequence (opt4) from CCHFV(UCCR4413)__KY484038.1__Gc
  source 1..1935: mol_type = other RNA
ttcctgagcagcatcgtgaagggcaagaagaacctgctgaacagcgccagcctggagaccagcctgagcatcgaggccccctggggcgccatcaacgcccagagcaccttcaagcccaccatcagcaccgccaacatcgccctgagctggagcagcgtggagcacagaggcaacaaggtgctggtgagcggcagaagcgagagcatcatgaagctggaggagagaaccggcatcagctggaacctgggcgtggaggacgccagcgagagcagaatgctgaccgtgagcgtgatggacctgagccagatgtacctgcccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgcccagcgagatcgtgaccctgcaccccaagatcgaggagggcttcttcgacctgatgcacgtgcagaaggtgctgagcgccagcaccgtgtgcaagctgcagagctgcacccacggcgtggccggcgacctgcaggtgtaccacgtgggcaacctgctgaagggcgacaagatcaacggccacagcatccacaagatcgagccccacctgaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagagcttccacttccacagcaagagagtgaccgcccacggcgacaccccccagctggacctgaaggccagacccatgtacggcgccggcgagatcaccgtgctggtggaggtggccgacatggagctgcacagcaagaacatcgagatcagcggcctgaagttcgccagcctgacctgcagcggctgctacgcctgcagcagcggcatcagctgcaaggtgagaatccacgtggacgagcccgacgagctggccgtgcacgtgaagagcgacgacctggacgtggtggccgccagcagcagcctgatggccagaaagatcgagttcggcaccgacagcaccttcaaggccttcagcagcatgcccaaggagagcctgtgcttctacatcgtggagagagacttctgcaagagctgcgccgccgaggacacccagaagtgcgtgaaggccaagctggagcagccccagagcatcctgatcgagcacaagggcaccatcatcggcaagcagaacgacacctgcagcaccaagaccagctgctggctggagagcttcaagagcttcttctacggcctgaagaacatgctgagcggcgtgttcggcagcgccatcatgggcatcctgctgttcctggcccccttcatcctgctgatcctgttcttcttcttcggctggagaatcctgttctgcctgagatgctgcagaagaaccagaggcctgttcaagtacaagcacatcaaggacgacgaggaggccggctacaagaagatcatcgagaagctgaacaacaagaagggcggcaccagcaagctgctggacggcgagagactggccgacagaaagatcgccgagctgttcagcaccaaggcccacatcggc

SEQ ID NO: 9106 - RNA, 1932 nt, synthetic construct
  misc_feature 1..1932: note = derived and/or modified CDS sequence (opt4) from CCHFV(66019)__AB069669.1__Gc
  source 1..1932: mol_type = other RNA
ttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcaactgccccgacagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaacagccaggagagacagtgcagcctgatcgaggccggcaccagattcaacctgggccccgtgaccatcaccctgagcgagcccagaaacatccagcagaagctgcccagcgagatcatcaccctgcaccccagaatcgaggagggcttcttcgacctgatgcacgtgcagaaggtgctgagcgccagcaccgtgtgcaagctgcagagctgcacccacggcgtgcccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgccatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagatacctgaaggacgacgaggagagcggctacagaagaatcatcgagagactgaacaacaagaagggcaagaacaagctgctggacggcgagagactggccgacagaagaatcgccgagctgttcagcaccaagacccacatcggc

SEQ ID NO: 9107 - RNA, 1932 nt, synthetic construct
  misc_feature 1..1932: note = derived and/or modified CDS sequence (opt4) from CCHFV(7001)__AB069670.1__Gc
  source 1..1932: mol_type = other RNA
ttcctggacaacatcgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccaggtgtaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcttcctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggc

SEQ ID NO: 9108 - RNA, 1932 nt, synthetic construct
  misc_feature 1..1932: note = derived and/or modified CDS sequence (opt4) from CCHFV(75024)__AB069671.1__Gc
  source 1..1932: mol_type = other RNA
ttcctggacagcatcgtgagaggcatgaagaaccagctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgatcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacctgatccacaagatcgagccccacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagttcacccccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacctgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9109 - RNA, 1932 nt, synthetic construct
  misc_feature 1..1932: note = derived and/or modified CDS sequence (opt4) from CCHFV(7803)__AB069672.1__Gc
  source 1..1932: mol_type = other RNA
ttcctggacagcatcgtgagaggcatgaagaaccccctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgatcgtgaagtggaaggtggagtacatcaagaccagaggcatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacctgatccacaagatcgagccccacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagttcacccccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacttcttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9110 - RNA, 1932 nt, synthetic construct
  misc_feature 1..1932: note = derived and/or modified CDS sequence (opt4) from CCHFV(79121)__AB069673.1__Gc
  source 1..1932: mol_type = other RNA
ttcctggacagcaccgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccagatctaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaacctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcttcctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggc

SEQ ID NO: 9111 - RNA, 1932 nt, synthetic construct
  misc_feature 1..1932: note = derived and/or modified CDS sequence (opt4) from CCHFV(8402)__AB069674.1__Gc
  source 1..1932: mol_type = other RNA
ttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagagcaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 9112 - RNA, 1932 nt, synthetic construct
  misc_feature 1..1932: note = derived and/or modified CDS sequence (opt4) from CCHFV(88166)__AB069675.1__Gc
  source 1..1932: mol_type = other RNA
ttcagcgacagcatcgtgaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctggaacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacctggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 9113 - RNA, 1932 nt, synthetic construct
  misc_feature 1..1932: note = derived and/or modified CDS sequence (opt4) from CCHFV(BA88166)__AF338470.1__Gc
  source 1..1932: mol_type = other RNA
tacctggacagcatcgtgaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctggaacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgatcatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 9114 - RNA, 1932 nt, synthetic construct
  misc_feature 1..1932: note = derived and/or modified CDS sequence (opt4) from CCHFV(BA66019)__AF350448.1__Gc
  source 1..1932: mol_type = other RNA
ttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgacagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaacagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgccatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagatacctgaaggacgacgaggagagcggctacagaagaatcatcgagagactgaacaacaagaagggcaagaacaagctgctggacggcgagagactggccgacagaagaatcgccgagctgttcagcaccaagacccacatcggc

SEQ ID NO: 9115 - RNA, 1932 nt, synthetic construct
  misc_feature 1..1932: note = derived and/or modified CDS sequence (opt4) from CCHFV(BA8402)__AF350449.1__Gc
  source 1..1932: mol_type = other RNA
ttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcatcaagtggaaggtggagtacatcaagaccgaggccatcgtgtgcgtggagctgaccagccaggagagacagtgcaccctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctgcactactactgcaacatgggcgactggcccagctgcacctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcgagagctgcagcaaggaggacacccagaagtgcgtgaacaccaagctggagcagccccagagcatcctgatcgagcacaagggcaccatcatcggcaagcagagcaacacctgcaccgccaaggccagctgctggctggagagcgtgaagagcttcttctacggcctgaagaacatgctgagcggcatcttcggcaacgtgttcatcggcgtgttcctgttcttcgcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 9116 - RNA, 1932 nt, synthetic construct
  misc_feature 1..1932: note = derived and/or modified CDS sequence (opt4) from CCHFV(Matin)__AF467769.2__Gc
  source 1..1932: mol_type = other RNA
ttcctggacagcatcatcaagggcatgaagaacctgctgaacagcaccagcctggagaccagcctgagcatcgaggccccctggggcgccatcaacgtgcagagcaccttcaagcccaccatgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggtgatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgagcatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcgccctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacgtgggc

SEQ ID NO: 9117 - RNA, 1932 nt, synthetic construct
  misc_feature 1..1932: note = derived and/or modified CDS sequence (opt4) from CCHFV(Baghdad 12)__AJ538197.2__Gc
  source 1..1932: mol_type = other RNA
ttcctggacagcatcgtgaagggcaccaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgacgccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggtgagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacttcttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9118 - RNA, 1932 nt, synthetic construct
  misc_feature 1..1932: note = derived and/or modified CDS sequence (opt4) from CCHFV(VLG/TI29414)__AY179961.1__Gc
  source 1..1932: mol_type = other RNA
ttcctggacagcatcgtgaagggcatgaagaacctgctgaacagcaccaacctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctgggaggtgggcaccggctgcacctgctgcggctggaacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcatgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtgatcgccgccagcaccagcctgatggccagaaagctggagttcggcaccgacagcaccttcaaggccttcagcgccatgcccaagaccagcctgtgcttctacatcgccgagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9119 - RNA, 1932 nt, synthetic construct
  misc_feature 1..1932: note = derived and/or modified CDS sequence (opt4) from CCHFV(TADJ/HU8966)__AY179962.1__Gc
  source 1..1932: mol_type = other RNA
ttcctggacagcatcgtgaagggcatgaagaaccccctgaacagcaccagcctggagaccagcctgagcatcgaggccccctggggcgccatcaacgtgcagagcacctacaagcccaccgtgagcaccgccaacatcgccctgagctggagcagcatcgagcacagaggcaacaacatcctggtgagcggcagaagcgagagcatcatgaagctggaggagagaaccggcatcagcggcgacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcatcgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggagaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtacagaaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgagctgcttcaagtgctgcagaagaaccagaggcctgctgaagcacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9120 - RNA, 1932 nt, synthetic construct
  misc_feature 1..1932: note = derived and/or modified CDS sequence (opt4) from CCHFV(Hodzha)__AY223476.1__Gc
  source 1..1932: mol_type = other RNA
ttcctggacagcatcgtgaagggcaccaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagagaaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcaagtacaagcacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9121 - RNA, 1932 nt, synthetic construct
  misc_feature 1..1932: note = derived and/or modified CDS sequence (opt4) from CCHFV(Kosovo/9553/2001)__AY675511.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcaagagctgcagcgaggacgacaccaagaagtgcgtggacaccaagctggagcagccccagagcatcctgatcgagcacagaggcaccatcatcggcaagcccaacgacacctgccccgccaagaccagctgctggctggagagcgtgaagagcttcttctacggcctgaagaacatgctgggcagcgtgttcggcaacttcttcatcggcatcctgctgttcctggcccccttcttcctgtggatgctgagcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9122 - RNA, 1932 nt, synthetic construct
  misc_feature 1..1932: note = derived and/or modified CDS sequence (opt4) from CCHFV(SPU41/84)__AY900142.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctggtgcacaagatcgagccccacttcaacaccagctggatgagctgggacggctgcgacctggactactactgcaacatgggcgactggcccagctgcacctacaccggcgtgacccagcacaaccacgccagcttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcaccagcctgacctgcaccggctgctacgcctgcagcagcggcatcagctgcaaggtgagaatccacgtggacgagcccgacgagctgaccgtgcacgtgaagagcgaggaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtgaacaccaagctggagcagccccagagcatcctgatcgagagaaagggcaccatcatcggcaagcagaacaacacctgcaaggccaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaagaatcgccgagctgttcagcaccaagacccacatcggc

SEQ ID NO: 9123 - RNA, 1932 nt, synthetic construct
  misc_feature 1..1932: note = derived and/or modified CDS sequence (opt4) from CCHFV(UG3010)__AY900143.1__Gc
  source 1..1932: mol_type = other RNA
tacctggacagcatcgccaagggcatgaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccaggagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacatccagcagagactgcccagcgagatcgtgaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcagcgaccccgacgtggtggccgccggcagcagcctgatggccagaaagatcgagttcggcgccgacagcaccttcaaggccttcagcagcatgcccaagaacagcctgtgcttctacatcgtggagagagactactgcagcagctgcaccaacgacgacacccagaagtgcgtggacaccaagctggagcacccccagagcatcctgatcgagcacaagggcaccatcatcggcaagcagaacgacacctgcagcaccaagaccagctgctggctggagagcgtgaagagcttcttctacggcctgaagaacatgctgggcggcatcttcggcaacgtgttcctgggcatcttcctgttcctggcccccttcgccctgctgatcttcttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccgagctgttcagcaccaagacccacatcggc

SEQ ID NO: 9124 - RNA, 1932 nt, synthetic construct
  misc_feature 1..1932: note = derived and/or modified CDS sequence (opt4) from CCHFV(Hy13)__AY900145.1__Gc
  source 1..1932: mol_type = other RNA
ttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 9125 - RNA, 1932 nt, synthetic construct
  misc_feature 1..1932: note = derived and/or modified CDS sequence (opt4) from CCHFV(Semunya)__DQ094832.1__Gc
  source 1..1932: mol_type = other RNA
ttcctggacagcatcgccaagggcaagaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacgtgcagcagagactgcccagcgagatcgtgaccctgcaccccaagatcgaggagggcttcttcgacctgatgcacgtgcagaaggtgctgttctgcaagtacagcctgcaggccaccagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcgtgaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagttcggcgccgacagcaccttcaaggccttcagcagcatgcccaagaacagcctgtgcttctacatcgtggagagagactactgcagcagctgcaccgacgacgacacccagaagtgcgtgaacatcaagctggagcacccccagagcatcctgatcgagcacaagggcaccatcatcggcaagcagaacgacacctgccccaccaagaccagctgctggctggagagcgtgaagagcttcttctacggcctgaagaacatgctgggcggcatcttcggcaacgtgttcctgggcatcttcctgttcctggcccccttcgccctgctgatcctgttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccaagctgttcagcaccaagacccacatcggc

SEQ ID NO: 9126 - RNA, 1932 nt, synthetic construct
  misc_feature 1..1932: note = derived and/or modified CDS sequence (opt4) from CCHFV(SPU128/81/7)__DQ157174.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatcggcatcttcctgttcctgggccccttcatcctgctgatcctgttcttcatgttcggctggagaatcctgttctgcttcaagtgctgcagaagaaccagaggcctgctgaagtacagacacctgaaggaggacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9127 - RNA, 1932 nt, synthetic construct
  misc_feature 1..1932: note = derived and/or modified CDS sequence (opt4) from CCHFV(ROS/HUVLV-100)__DQ206448.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9128 - RNA, 1932 nt, synthetic construct
  misc_feature 1..1932: note = derived and/or modified CDS sequence (opt4) from CCHFV(AP92)__DQ211625.1__Gc
  source 1..1932: mol_type = other RNA
ttcctggacagcatcgccaagggcgtgaagaacctgctgaacagcaccagcctggagaccagcctgagcatcgaggccccctggggcgccatcaacgcccagagcacctacaagcccaccgccagcagcgccaacatcgccctgacctggagcagcgtggagcacagaggcaacaagatcctggtgagcggcagaagcgagagcatcatgaagctggaggagagaaccggcatcagctggaacctgggcgtggaggacgccagcgagagcagaaccctgaccatcagcgtgatggacctgagccagatgtacagccccgtgttcgagtacctgagcggcgacagacaggtggaggagtggcccaaggccacctgcaccggcaactgccccgagagatgcggctgcaccagcagcacctgcctgtacaaggagtggccccacagcagaaactggagatgcaaccccacctggtgctggggcgtgggcaccggctgcacctgctgcggcctggacgtgaaggagctgttcaccgaccacatgctggtgaagtggaaggtggagtacatcaagaccgaggccatcgtgtgcgtggagctgaccagccaggagagacagtgcagcctgatcgaggccggcaccagattcagcctgggccccgtgaccatcaccctgagcgagcccagaaacatccagcagaagctgccccccgagctgatcaccctgcaccccaagatcgaggacggctacttcgacctgatgcacgtgcagaaggtgatgagcgccagcaccgtgtgcaagctgcagagctgcacccacggcgtgcccggcgacctgcagatctaccacgtgggcaacctgctgaagggcgacagagtgaacggccacctgatccacaaggtggagccccacctgaacaccagctggatgagctgggacggctgcgacctggactacttctgcaacatgggcgactggcccagctgcacctacaccggcgtgacccagcacaaccacgccgccttcgccaacctgctgaacatcgagaccgactacaccaagaccttccacttccacagcaagagagtgaccgcccacggcgacaccccccagctggacctgaaggccagacccagatacggcgccggcgagatcaccgtgctggtggaggtggccgacatggagctgcacaccaagaaggtggaggtgaccggcctgaagttcgccagcctgacctgcagcggctgctacgcctgcagcagcggcatcagctgcaaggtgagaatccacgtggacgagcccgacgagctgaccgtgcacgtgaagagcagcgaccccgacatcgtggccgccagcagcagcctgatggccagaaagatcgagttcggcgtggacagcaccttcaaggccttcagcagcatgcccaaggacagcctgtgcttctacatcgtggagagagactactgcaacagctgcaagaacgaggagacccagagatgcgtgaacgccaagctggagcagccccagagcatcctgatcgagcacaccggcaccatcatcggcaagcagaacgacacctgcggcagcagaaccagctgctggctggacagcttcaagagcttcttctacggcctgaagagcatgctgagcggcatcttcggcaacgtgttcctgggcatcttcctgttcctggcccccttcgccctgctgctgttcttcttcttcttcggctggagaatcctgttctgcttcaagtgctgcagaagaaccagaggcctgttcaagtacagacacatcaaggacgacgaggaggtgggctacaagaagatcatcgagagactgaacaacaagaagggcaagcacagactgctggacggcgagagactggccgacagaaagatcgccgagctgttcagcaccaagacccacatcggc

SEQ ID NO: 9129 - RNA, 1932 nt, synthetic construct
  misc_feature 1..1932: note = derived and/or modified CDS sequence (opt4) from CCHFV(ArD8194)__DQ211626.1__Gc
  source 1..1932: mol_type = other RNA
ttcctggacagaatcgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacaagggcaacaagatcctggtgagcggcagaagcgagagcatcatgaagctggaggagagaaccggcatcagctggtgcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgctggtgaagtggaaggtggagtacatcaagaccgaggccatcatctgcgtggagctgaccagccaggagagacagtgcagcctgatcgaggccggcaccagattcaacctgggccccgtgaccatcaccctgagcgagcccagaaacgtgcagcagagactgccccccgagatcatcaccctgcaccccaagatcgaggagggcttcttcgacctgatgcacgtgcagaaggtgatgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacctgaacaccagctggatgagctgggacggctgcgacctggactacttctgcaacatgggcgactggcccagctgcacctacaccggcgtgacccagcacaaccacgccgccttcatcaacatgctgaacatcgagaccgactacaccaagaccttccacttccacagcaagagagtgaccgcccacggcgacaccccccagctggacctgaaggccagacccgcctacggcgccggcgagatcaccgtgctggtggaggtggccgacctggagctgcacaccaagaagatcgaggtgagcggcctgaagttcgccagcctgagctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagagcggcgccgacagcaccttcaaggccttcagcagcatgcccaagaacagcctgtgcttctacatcgtggagagagactactgcagcagctgcaccgacgacgacacccagaagtgcgtggacatcaagctggagcacccccagagcatcctgatcgagcacaagggcaccatcatcggcaagcagaacgacacctgccccaccaagaccagctgctggctggagagcatcaagagcttcttctacggcctgaagaacatgctgagcggcatcttcggcaacgtgttcctgggcatgctgctgttcctggcccccttcatcctgctgatcctgttcttcttcttcggctggagactgctgttctgcctgaagtgctgcagaagaaccagaaagctgctgaagtacaagcacctgagagacgaggaggagagcggctacaagaagatcatcgagagactgaacgacaagaagggcaagagcagactgttcgacggcgagagactggccgacagaaagatcgccgagctgttcagcaccaagacccacatcggc

SEQ ID NO: 9130 - RNA, 1932 nt, synthetic construct
  misc_feature 1..1932: note = derived and/or modified CDS sequence (opt4) from CCHFV(ArD15786)__DQ211627.1__Gc
  source 1..1932: mol_type = other RNA
agcctggacagcatcgccaagggcatgaagagcctgctgaacagcaccagcctggagaccagcctgagcatcgaggccccctggggcgccatcaacgtgcagagcaccttcaagcccaccatcagcgccgccaacatcgccctgagctggagcagcgtggagcacaagggcaacaagatcctggtgagcggcagaagcgagagcatcatgaagctggaggagagaaccggcatcagctggtgcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgctggtgaagtggaaggtggagtacatcaagaccgaggccatcatctgcgtggagctgaccagccaggagagacagtgcagcctgatcgaggccggcaccagattcaacctgggccccgtgaccatcaccctgagcgagcccagaaacgtgcagcagagactgccccccgagatcatcaccctgcaccccaagatcgaggagggcttcttcgacctgatgcacgtgcagaaggtgatgagcgccagcaccgtgtgcaagctgcagagctgcacccacggcgtgcccggcgacctgcaggtgtaccacgtgggcaacctgctgaagggcgacaaggtgaacggccacagcatccacaagatcgagagccacctgaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagagcggcgccgacagcaccttcaaggccttcagcagcatgcccaagaacagcctgtgcttctacatcgtggagagagactactgcagcagctgcaccgacgacgacacccagaagtgcgtggacatcaagctggagcacccccagagcatcctgatcgagcacaagggcaccatcatcggcaagcagaacgacacctgccccaccaagaccagctgctggctggagagcatcaagagcttcttctacggcctgaagaacatgctgagcggcatcttcggcaacatcttcctgggcatgctgctgttcctggcccccttcgtgctgctgatcctgttcttcttcttcggctggagactgctgttctgcctgaagtgctgcagaagaaccagaaagctgctgaagtacaagcacctgagagacgaggaggagagcggctacaagaagatcatcgagagactgaacgacaagaagggcaagagcagactgttcgacggcgagagactggccgacagaaagatcgccgagctgttcagcaccaagacccacgtgggc

SEQ ID NO: 9131 - RNA, 1932 nt, synthetic construct
  misc_feature 1..1932: note = derived and/or modified CDS sequence (opt4) from CCHFV(ArD39554)__DQ211628.1__Gc
  source 1..1932: mol_type = other RNA
ttcctggacagcaccgccaagagcatgaagagcctgctgaacagcaccagcctggagaccagcctgagcatcgaggccccctggggcgccatcaacgtgcagagcaccttcaagcccaccgccagcaccgccaacatcgccctgagctggagcagcgtggagcacagaggcaacaagatcctggtgaccggcagaagcgagagcatcatgaagctggaggagagaaccggcatcagctggaacctgggcgtggaggacgccagcgagagcaagaccctgaccgtgagcgtgatggacctgagccagatgtacagcaccgtgttcgagtacctgagcggcgacagacaggtggaggagtggcccaaggccacctgcaccggcgactgccccgagagatgcggctgcaccagcagcacctgcctgcacaaggcctggccccacagcagaaactggagatgcaaccccacctggtgctggggcgtgggcaccggctgcacctgctgcggcctggacgtgaagaacctgttcaccgactacatgctgatcaagtggaaggtggagttcatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagctggtgaccctgcaccccagagtggaggagggcttcttcgacctgatgcacgtgcagaaggtgctgagcgccagcaccgtgtgcaagctgcagagctgcacccacggcgtgcccggcgacctgcaggtgtaccacgtgggcaacctgctgaagggcgacaagatcaacggcaacagcttccacaagatcgagcccaacctgaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgagaccccccagctggacctgaaggccagacccaagtacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgagactgcacgtggacgagcccgacgagctgaccgtgcacgtgaagagcgacgaccccgacgtggtggccgccagcagcagcctgatggccagaaagatcgagttcggcaccgacagcaccttcaaggccttcagcagcatgcccaaggacaagctgtgcttctacatcgtggagagagactactgcagcagctgcagcaaggaggacacccagaagtgcgtgaacgccaagctggagcagccccagagcatcctgatcgagcacaagggcaccatcatcggcaagcagaacgacacctgcaccgtgaaggccagctgctggctggagagcgtgaagagcttcttctacggcctgaagaacatgctgggcggcatcttcggcaacgtgatcctgggcatcatcatgttcctggcccccttcgccctgctgctgctgttcttcctgttcggctggagaatcctgttctgcctgagatgctgcagaagaaccagaggcctgttcaagtacaagcacatcaaggacgacgaggagagcggctacaagagaatcatcgagagactgaacaacaagaagggcaagaacaagctgttcgacggcgagagactggccgacaagaagatcgccgagctgttcagcaccaagacccacatcggc

SEQ ID NO: 9132 - RNA, 1932 nt, synthetic construct
  misc_feature 1..1932: note = derived and/or modified CDS sequence (opt4) from CCHFV(C-68031)__DQ211629.1__Gc
  source 1..1932: mol_type = other RNA
ttcagcgacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgaagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagatcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccagcaaggccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 9133 - RNA, 1932 nt, synthetic construct
  misc_feature 1..1932: note = derived and/or modified CDS sequence (opt4) from CCHFV(Drosdov)__DQ211630.1__Gc
  source 1..1932: mol_type = other RNA
ttcctggacagcaccgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatgaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcaactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggtgtgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcatcttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9134 - RNA, 1932 nt, synthetic construct
  misc_feature 1..1932: note = derived and/or modified CDS sequence (opt4) from CCHFV(Kashmanov)__DQ211631.1__Gc
  source 1..1932: mol_type = other RNA
ttcctggacagcatcgtgaagggcatgaagaacagcctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9135 - RNA, 1932 nt, synthetic construct
  misc_feature 1..1932: note = derived and/or modified CDS sequence (opt4) from CCHFV(Oman)__DQ211632.1__Gc
  source 1..1932: mol_type = other RNA
ttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 9136 - RNA, 1932 nt, synthetic construct
  misc_feature 1..1932: note = derived and/or modified CDS sequence (opt4) from CCHFV(SPU97/85)__DQ211633.1__Gc
  source 1..1932: mol_type = other RNA
ttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacacccagaagtgcgtgaacaccaagctggagagaccccagagcatcctgatcgagcacaagggcaccatcatcggcaagcagaacgacacctgcaccgccaaggccagctgctggctggagagcgtgaagagcttcttctacggcctgaagagcatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggc

SEQ ID NO: 9137 - RNA, 1932 nt, synthetic construct
  misc_feature 1..1932: note = derived and/or modified CDS sequence (opt4) from CCHFV(SPU103/87)__DQ211634.1__Gc
  source 1..1932: mol_type = other RNA
ttcctggacaacatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaagatcgagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgcccagcgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctggtgcacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcaccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtgaacaccaagctggagcagccccagagcatcctgatcgagcacaagggcaccatcatcggcaagcagaacaacacctgcaaggccagagccggctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaagaatcgccgagctgttcagcaccaagacccacatcggc

SEQ ID NO: 9138 - RNA, 1932 nt, synthetic construct
  misc_feature 1..1932: note = derived and/or modified CDS sequence (opt4) from CCHFV(SPU415/85)__DQ211635.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagagagtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgaagatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacaccagaaagtgcgtgaacaccaagctggacagaccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggc

SEQ ID NO: 9139 - RNA, 1932 nt, synthetic construct
  misc_feature 1..1932: note = derived and/or modified CDS sequence (opt4) from CCHFV(Turkey200310849)__DQ211636.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccgccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggc

SEQ ID NO: 9140 - RNA, 1932 nt, synthetic construct
  misc_feature 1..1932: note = derived and/or modified CDS sequence (opt4) from CCHFV(Iran-52)__DQ446215.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggaggagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 9141 - RNA, 1932 nt, synthetic construct
  misc_feature 1..1932: note = derived and/or modified CDS sequence (opt4) from CCHFV(Iran-53)__DQ446216.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 9142 - RNA, 1932 nt, synthetic construct
  misc_feature 1..1932: note = derived and/or modified CDS sequence (opt4) from CCHFV(Kosova Hoti)__EU037902.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgcccccagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccggcaccagcctgatggccagaaagctggagttcggcaccgacagcaccttcaaggccttcagcgccatgcccaagaccagcctgtgcttctacatcgtggagaaggagtactgcaagagctgcagcgaggacgacaccaagaagtgcgtggacaccaagctggagcagccccagagcatcctgatcgagcacagaggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9143 - RNA, 1932 nt, synthetic construct
  misc_feature 1..1932: note = derived and/or modified CDS sequence (opt4) from CCHFV(YL04057)__FJ562094.1__Gc
  source 1..1932: mol_type = other RNA
ttcctggacagcatcgccaagggcaagaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcagccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccaggtgtaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcctgctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggc

SEQ ID NO: 9144 - RNA, 1932 nt, synthetic construct
  misc_feature 1..1932: note = derived and/or modified CDS sequence (opt4) from CCHFV(V42/81)__GU477490.1__Gc
  source 1..1932: mol_type = other RNA
ttcctggacagcatcgtgaagggcaagaagaacctgctgaacagcaccagcctggagaccagcctgagcatcgaggccccctggggcgccatcaacatccagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcatcgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgagaccccccagctggacctgaaggccagacccgcctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagagcggcaccgacagcaccttcaaggccttcagcgccatgcccaagaccagcctgtgcttctacatcgtggagagagagtactgcaagagctgcagcgaggacgacacccagaagtgcgtggagaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggaggacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9145 - RNA, 1932 nt, synthetic construct
  misc_feature 1..1932: note = derived and/or modified CDS sequence (opt4) from CCHFV(79121M18)__GU477493.1__Gc
  source 1..1932: mol_type = other RNA
ttcctggacagcaccgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccagatctaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctggagagcgtgaagggcttcttctacggcctgaagaacatgctgagcggcatcttcggcaacgtgttcctgggcatcttcctgttcctggcccccttcgtgctgctgatcttcttcttcttcttcggctggagactgctgttctgcctgaagtgctgcagaagaaccagaggcctgctgaagtacaagcacctgaaggacgaggaggaggccggctacaagaagatcatcgagagactgaacggcaagaagggcaagagccagctgttcgacggcgagagactggccgacagaaagatcgccgagctgttcagcaccaagatccacatcggc

SEQ ID NO: 9146 - RNA, 1932 nt, synthetic construct
  misc_feature 1..1932: note = derived and/or modified CDS sequence (opt4) from CCHFV(Afg09-2990)__HM452306.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 9147 - RNA, 1932 nt, synthetic construct
  misc_feature 1..1932: note = derived and/or modified CDS sequence (opt4) from CCHFV(Sudan Al-Fulah 3-2008)__HQ378184.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagaaggagtactgcaagagctgcagcgaggaggacaccaagaagtgcgtgaacaccaagctggagcagccccagagcatcctgatcgagcacaagggcaccatcatcggcaagcagaacagcacctgcaccgccaaggtgagctgctggctggagagcgccaagagcttcttctacggcctgaaggacatgctgagcggcatcttcggcaacgtgttcatcggcatcttcctgttcctggcccccttcgtgctgctggtgctgttcttcatgttcggctggagaatcctgctgtgcttcagatgctgcagaagaaccagaggcctgttcaagtacagacacctgaaggacgacgaggagaccggctacagaagaatcatcgagagactgaacaacaagaagggcaagaacaagctgctggacggcgagagactggccgacagaaagatcgccgagctgttcagcaccaagacccacatcggc

SEQ ID NO: 9148 - RNA, 1932 nt, synthetic construct
  misc_feature 1..1932: note = derived and/or modified CDS sequence (opt4) from CCHFV(Sudan AB1-2009)__HQ378187.1__Gc
  source 1..1932: mol_type = other RNA
ttcctggacagcatcgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcaacgaggaggacaccaagaagtgcgtgaacaccaagctggagcagccccagagcatcctgatcgagcacaagggcaccatcatcggcaagcagaacagcacctgcaccgccagagccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9149 - RNA, 1932 nt, synthetic construct
  misc_feature 1..1932: note = derived and/or modified CDS sequence (opt4) from CCHFV(NIVA 118595)__JN572083.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagagcggcaccgacagcaccttcaaggccttcagcgccatgcccaagaccagcctgtgcttctacatcgtggagagagagtactgcaagggctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcctgggcatcttcagcttcctggcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 9150 - RNA, 1932 nt, synthetic construct
  misc_feature 1..1932: note = derived and/or modified CDS sequence (opt4) from CCHFV(NIV 112143)__JN572085.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacctgaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgagctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagggctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcctgggcatcttcagcttcctggcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 9151 - RNA, 1932 nt, synthetic construct
  misc_feature 1..1932: note = derived and/or modified CDS sequence (opt4) from CCHFV(SCT ex Afghanistan)__KC344856.1__Gc
  source 1..1932: mol_type = other RNA
ttcctgaacagcatcgtgaagggcatgaagaacctgctgaacagcaccaacctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagagcctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaagctgaacggccacatgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgacatcagcggcctgaagttcgccagcctgacctgcgccggctgctacgcctgcagcagcggcatcagctgcaaggtgagaatccacgtggacgagcccgacgagctgaccgtgcacgtgaagagcgaggaccccgacatcgtggccgccagcaccagcctgatcgccagaaagctggagctgggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagggcatcctgatcgagcacaagggcaccatcatcggcaagcagaacgacacctgcaccgccaaggccggctgctggctggagagcgtgaagagcttcttctacggcctgaagaacatgctgagcggcatcttcggcaacgtgttcatcggcatcttcctgttcctggcccccttcgtgctgctgatcctgttcttcatgttcggctggagactgctgttctgcttcaagtgctgcagaagaaccagaggcctgttcaagtacagacacctgaaggaggacgaggagagcggctacagaagaatcatcgagagactgaacaacaagaagggcaagaacaagctgctggacggcgagagactggccgacagaagaatcgccgagctgttcagcaccaagacccacatcggc

SEQ ID NO: 9152 - RNA, 1932 nt, synthetic construct
  misc_feature 1..1932: note = derived and/or modified CDS sequence (opt4) from CCHFV(Zahedan 2007)__KC867273.1__Gc
  source 1..1932: mol_type = other RNA
ttcctggacagcatcgtgaaggacatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcttcttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 9153 - RNA, 1932 nt, synthetic construct
  misc_feature 1..1932: note = derived and/or modified CDS sequence (opt4) from CCHFV(SPU 44/08)__KJ682805.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcatcaagagcttcttctacggcctgaagaacatgctgagcggcatcttcggcaacgtgttcatcggcatcttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggc

SEQ ID NO: 9154 - RNA, 1932 nt, synthetic construct
  misc_feature 1..1932: note = derived and/or modified CDS sequence (opt4) from CCHFV(SPU 383/87)__KJ682806.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcttcggcaagcagaacgacacctgcaccgccaaggccagctgctggctggagagcgtgaagagcttcttctacggcctgaagaacatgctgagcggcatcttcggcaacgtgttcatcggcgtgttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggc

SEQ ID NO: 9155 - RNA, 1932 nt, synthetic construct
  misc_feature 1..1932: note = derived and/or modified CDS sequence (opt4) from CCHFV(SPU 130/89)__KJ682807.1__Gc
  source 1..1932: mol_type = other RNA
agcctggacagcatcgtgaagggcatgaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagcactgcaagagctgcagcaaggaggacacccagagatgcgtgaacaccaagctggagcagccccagagcatcctgatcgagcacaagggcaccatcatcggcaagcagaacgacacctgcaccgccaaggccagctgctggctggagagcatcaagagcttcttctacggcctgaagaacatgctgagcggcatcttcggcaacgtgttcatcggcgtgttcctgttcctggcccccttcatcatcctgatcctgttcttcatgttcggctggagaatcctgttctgcttcaagtgctgcagaagaaccagaggcctgctgaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggc

SEQ ID NO: 9156 - RNA, 1932 nt, synthetic construct
  misc_feature 1..1932: note = derived and/or modified CDS sequence (opt4) from CCHFV(SPU 497/88)__KJ682808.1__Gc
  source 1..1932: mol_type = other RNA
ttcctggacagcatcgtgaagggcatgagaaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccagagccagctgctggctggagagcatcaagagcttcttctacggcctgaagaacatgctgagcggcatcttcggcaacgtgttcatcggcatcttcctgttcttcgcccccttcatcatgctgatcctgttcttcatgttcggctggagaatcctgttctgcttcaagtgctgcagaagaaccagaggcctgttcaagtacagacacctgaaggacgacgaggaggtgggctacagaaagatcatcgagagactgaacaacaagaagggcaagaacaagctgctggacggcgagagactggccgacagaaagatcgccgagctgttcagcaccaagacccacatcggc

SEQ ID NO: 9157 - RNA, 1932 nt, synthetic construct
  misc_feature 1..1932: note = derived and/or modified CDS sequence (opt4) from CCHFV(SPU 18/88)__KJ682810.1__Gc
  source 1..1932: mol_type = other RNA
ttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacatccagaaggtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccggcaaggccggctgctggctggagagcatcaagagcttcttctacggcctgaagaacatgctgagcggcatcttcggcaacgtgttcatcggcatcttcctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaagaacaagaagggcaagaacaagctgctggacggcgagagactggccgacagaaagatcgccgagctgttcagcaccaagacccacatcggc

SEQ ID NO: 9158 - RNA, 1932 nt, synthetic construct
  misc_feature 1..1932: note = derived and/or modified CDS sequence (opt4) from CCHFV(SPU 431/85)__KJ682812.1__Gc
  source 1..1932: mol_type = other RNA
ttcctggacagcatcgtgaagggcagaaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagagagtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgaggtgaccgtgctggtggaggtggccgacatggagctgcacaccaagaagatcgagatcagcggcctgaagttcgccagcctgacctgcaccggctgctacgcctgcagcagcggcatcagctgcaaggtgaagatccacgtggacgagcccgacgagctgaccgtgcacgtgaagagcgaggaccccgacatcgtggccgccggcagcagcctgatggccagaaagctggagttcggcgccgacagcaccttcaaggccttcagcgccatgcccaagaccagcctgtgcttctacatcgtggagagagagtactgcaagagctgcagcagagaggacaccagaaagtgcgtgaacaccaagctggacagaccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcatcggcatcttcctgttcatcgcccccttcgtgctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagagccacatcggc

SEQ ID NO: 9159 - RNA, 1932 nt, synthetic construct
  misc_feature 1..1932: note = derived and/or modified CDS sequence (opt4) from CCHFV(SPU 48/90)__KJ682813.1__Gc
  source 1..1932: mol_type = other RNA
ttcagagacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaacagagccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagaaggagtactgcaagagctgcagcgaggaggacaccaagaagtgcgtgaacaccaagctggagcagccccagagcatcctgatcgagcacaagggcaccatcatcggcaagcagaacagcacctgcaccgccaaggtgagctgctggctggagagcgccaagagcttcttctacggcctgaaggacatgctgagcggcatcttcggcaacgtgttcatcggcatcttcctgttcctggcccccttcatcctgctgatcctgttcttcatgttcggctggagaatcctgctgtgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9160 - RNA, 1932 nt, synthetic construct
  misc_feature 1..1932: note = derived and/or modified CDS sequence (opt4) from CCHFV(SPU 187/90)__KJ682814.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcatcttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaagaccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9161 - RNA, 1932 nt, synthetic construct
  misc_feature 1..1932: note = derived and/or modified CDS sequence (opt4) from CCHFV(Haskovo-V46/13)__KR092379.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccggcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccaagctggagcagccccagagcatcctgatcgagcacaagggcaccatcatcggcaagcagaacgacacctgcaccgccagagccagctgctggctggagagcgtgaagagcttcttctacggcctgaagaacatgctgggcagcgtgttcggcaacttcctgatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9162 - RNA, 1932 nt, synthetic construct
  misc_feature 1..1932: note = derived and/or modified CDS sequence (opt4) from CCHFV(24-R-2012)__KR814856.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9163 - RNA, 1932 nt, synthetic construct
  misc_feature 1..1932: note = derived and/or modified CDS sequence (opt4) from CCHFV(36-ST-2014)__KR814857.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggaccagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgtgcggctggaagttcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagagccacatcggc

SEQ ID NO: 9164 - RNA, 1932 nt, synthetic construct
  misc_feature 1..1932: note = derived and/or modified CDS sequence (opt4) from CCHFV(37-R-2013)__KR814858.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggacgacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgtgacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9165 - RNA, 1932 nt, synthetic construct
  misc_feature 1..1932: note = derived and/or modified CDS sequence (opt4) from CCHFV(44-ST-2010)__KR814859.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggaccagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgtgcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagagccacatcggc

SEQ ID NO: 9166 - RNA, 1932 nt, synthetic construct
  misc_feature 1..1932: note = derived and/or modified CDS sequence (opt4) from CCHFV(46-ST-2012)__KR814860.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccagactggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9167 - RNA, 1932 nt, synthetic construct
  misc_feature 1..1932: note = derived and/or modified CDS sequence (opt4) from CCHFV(47-ST-2013)__KR814861.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgagtgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9168 - RNA, 1932 nt, synthetic construct
  misc_feature 1..1932: note = derived and/or modified CDS sequence (opt4) from CCHFV(52-R-2014)__KR814862.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggacgacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcaacgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccggctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9169 - RNA, 1932 nt, synthetic construct
  misc_feature 1..1932: note = derived and/or modified CDS sequence (opt4) from CCHFV(75-R-2012)__KR814863.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcctgtacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagactgctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9170 - RNA, 1932 nt, synthetic construct
  misc_feature 1..1932: note = derived and/or modified CDS sequence (opt4) from CCHFV(75-ST-2010)__KR814864.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagagccagaggcctgctgaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 9171 - RNA, 1932 nt, synthetic construct
  misc_feature 1..1932: note = derived and/or modified CDS sequence (opt4) from CCHFV(3756-ST-2007)__KR814866.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctgacccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9172 - RNA, 1932 nt, synthetic construct
  misc_feature 1..1932: note = derived and/or modified CDS sequence (opt4) from CCHFV(3809-ST-2007)__KR814867.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcagaagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctgacccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9173 - RNA, 1932 nt, synthetic construct
  misc_feature 1..1932: note = derived and/or modified CDS sequence (opt4) from CCHFV(3820-ST-2007)__KR814868.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9174 - RNA, 1932 nt, synthetic construct
  misc_feature 1..1932: note = derived and/or modified CDS sequence (opt4) from CCHFV(4495-ST-2008)__KR814869.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcatcagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagagatgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagagccagaggcctgctgaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 9175 - RNA, 1932 nt, synthetic construct
  misc_feature 1..1932: note = derived and/or modified CDS sequence (opt4) from CCHFV(4691-ST-2009)__KR814871.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccgccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9176 - RNA, 1932 nt, synthetic construct
  misc_feature 1..1932: note = derived and/or modified CDS sequence (opt4) from CCHFV(4701-ST-2009)__KR814872.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcggcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9177 - RNA, 1932 nt, synthetic construct
  misc_feature 1..1932: note = derived and/or modified CDS sequence (opt4) from CCHFV(Oman-199809166)__KR864901.1__Gc
  source 1..1932: mol_type = other RNA
ttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 9178 - RNA, 1932 nt, synthetic construct
  misc_feature 1..1932: note = derived and/or modified CDS sequence (opt4) from CCHFV(200406546-Turkey)__KR864902.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcatcgagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgaccgccagaaagctggagttcggcaccgacagcaccttcaaggccttcagcgccatgcccaagaccagcctgtgcttctacatcgtggagaaggagtactgcaagagctgcaacgaggacgacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacaagagaatcatcgagagactgaacaacaagaagggcaagaacagactgctggacggcgagagactggccgacagaaagatcgccgagctgttcagcaccaagacccacatcggc

SEQ ID NO: 9179 - RNA, 1932 nt, synthetic construct
  misc_feature 1..1932: note = derived and/or modified CDS sequence (opt4) from CCHFV(1-CR/HU-2015)__KU161584.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9180 - RNA, 1932 nt, synthetic construct
  misc_feature 1..1932: note = derived and/or modified CDS sequence (opt4) from CCHFV(Gaib)__KX013445.1__Gc
  source 1..1932: mol_type = other RNA
ttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcatcgagcacagaggcaacaagatcctggtgagcggcagaagcgagagcatcatgaagctggaggagagaaccggcatcagctgggacctgggcgtggaggacgccagcgagagcagactgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcagagaggacacccagaagtgcgtgagcaccaagctggagcagccccagagcatcctgatcgagcacaagggcaccatcatcggcaagcagaacaacacctgcaccaccaagaccacctgctggctggagagcgtgaagagcttcttctacggcctgaagaacatgctgagcagcatcttcggcaacgtgttcgtgggcatcttcagcttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagagcaagctgctggacggcgagagactggccgacagaaagatcgccgagctgttcagcaccaagacccacatcggc

SEQ ID NO: 9181 - RNA, 1932 nt, synthetic construct
  misc_feature 1..1932: note = derived and/or modified CDS sequence (opt4) from CCHFV(Hodzha)__KX013448.1__Gc
  source 1..1932: mol_type = other RNA
ttcctggacagcatcgtgaagggcaagaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgcagcgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctggtggaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccacctacggcgccggcgagatcaccgtgctggtggaggtggccgacatggagctgcacaccaagaagatcgagatcaccggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcagaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcaagtacaagcacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9182 - RNA, 1932 nt, synthetic construct
  misc_feature 1..1932: note = derived and/or modified CDS sequence (opt4) from CCHFV(IbAn7620)__KX013451.1__Gc
  source 1..1932: mol_type = other RNA
ttcctggacagcatcgccaagggcatgaagaaccccctgaacagcaccagcctggagaccagcctgagcatcgaggccccctggggcgccatcgacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccaacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9183 - RNA, 1932 nt, synthetic construct
  misc_feature 1..1932: note = derived and/or modified CDS sequence (opt4) from CCHFV(K128_76)__KX013454.1__Gc
  source 1..1932: mol_type = other RNA
ttccaggacagcatcgtgaagggcatgaagaacctgctgaacagcaccagcctggagaccagcctgagcatcgaggccccctggggcgccatcaacgtgcagagcacctacaagcccgccgtgagcgccgccaacatcgccctgagctggagcagcgtggagcacagaggcagcaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggagaacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9184 - RNA, 1932 nt, synthetic construct
  misc_feature 1..1932: note = derived and/or modified CDS sequence (opt4) from CCHFV(K168_40)__KX013457.1__Gc
  source 1..1932: mol_type = other RNA
ttcctggacggcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcatcaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9185 - RNA, 1932 nt, synthetic construct
  misc_feature 1..1932: note = derived and/or modified CDS sequence (opt4) from CCHFV(K168_125)__KX013460.1__Gc
  source 1..1932: mol_type = other RNA
ttcctggacagcatcgtgaagggcaagaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcatcaacctgctgaacatcgagaccgactacaccaagagcttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcacccccagagcatcctgatcgagcacaagggcaccatcatcggcaagcagaacaacacctgcaccgccaagaccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9186 - RNA, 1932 nt, synthetic construct
  misc_feature 1..1932: note = derived and/or modified CDS sequence (opt4) from CCHFV(K229_194)__KX013463.1__Gc
  source 1..1932: mol_type = other RNA
ttcctggacagcatcgtgaagggcaagaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacagctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggc

SEQ ID NO: 9187 - RNA, 1932 nt, synthetic construct
  misc_feature 1..1932: note = derived and/or modified CDS sequence (opt4) from CCHFV(K229_243)__KX013466.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagaaggagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctgacccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9188 - RNA, 1932 nt, synthetic construct
  misc_feature 1..1932: note = derived and/or modified CDS sequence (opt4) from CCHFV(K315_14)__KX013469.1__Gc
  source 1..1932: mol_type = other RNA
ttcctggacagcatcgtgaagggcatgaagaagctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9189 - RNA, 1932 nt, synthetic construct
  misc_feature 1..1932: note = derived and/or modified CDS sequence (opt4) from CCHFV(K323_27)__KX013472.1__Gc
  source 1..1932: mol_type = other RNA
ttcctggacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccggccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaacgacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9190 - RNA, 1932 nt, synthetic construct
  misc_feature 1..1932: note = derived and/or modified CDS sequence (opt4) from CCHFV(K340_6)__KX013475.1__Gc
  source 1..1932: mol_type = other RNA
agcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtgaccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacttcaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9191 - RNA, 1932 nt, synthetic construct
  misc_feature 1..1932: note = derived and/or modified CDS sequence (opt4) from CCHFV(Mamon)__KX013478.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaagaccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9192 - RNA, 1932 nt, synthetic construct
  misc_feature 1..1932: note = derived and/or modified CDS sequence (opt4) from CCHFV(Min)__KX013481.1__Gc
  source 1..1932: mol_type = other RNA
ttcctggacagcatcgtgaagggcaccaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagaatcaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9193 - RNA, 1932 nt, synthetic construct
  misc_feature 1..1932: note = derived and/or modified CDS sequence (opt4) from CCHFV(Nakiwogo)__KX013484.1__Gc
  source 1..1932: mol_type = other RNA
tacctggacagcatcgccaagggcatgaagagcctgctgaacagcaccaacctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctggagcctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgagagacctgttcaccgactacatgatggtgaagtggaaggtggagtacgtgaagaccgaggccatcatgtgcgtggagctgaccagccaggagagacagtgcagcctgatcgaggccggcaccagattcaacctgggccccgtgaccatcaccctgagcgagcccagaaacgtgcagcagagactgcccagcgagatcgtgaccctgcaccccaagatcgaggagggcttcttcgacctgatgcacgtgcagaaggtgctgttctgcaagcacagcctgcaggccaccagctgcacccacggcgtgcccggcgacctgcaggtgtaccacgtgggcaacctgctgaagggcgacaaggtgaacggccacagcatccacaagatcgagagccacttcaacaccagctggatgagctgggacggctgcgacctggactacttctgcaacatgggcgactggcccagctgcacctacaccggcgtgacccagcacaacagagccgccttcgtgaacatgctgaacatcgagaccgactacaccaagaccttccacttccacagcaagagagtgaccgcccacggcgacaccccccagctggacctgaaggccagacccacctacggcgccggcgaggtgaccgtgctggtggaggtggccgacctggagctgcacaccaagaagatcgaggtgagcggcctgaagttcgccagcctgacctgcagcggctgctacgcctgcagcagcggcatcagctgcaaggtgagaatccacgtgaacgagcccgacgagttcaccgtgcacgtgaagagcaacgaccccgacgtggtggccgccggcagcagcctgatggccagaaagatcgagctgggcgccgacagcaccttcaaggccttcagcagcatgcccaagaacagcctgtgcttctacatcgtggagagagactactgcagcagctgcaccgacgacgacacccagaagtgcgtgaacaccaagctggagcacccccagagcatcctgatcgagcacaagggcaccatcatcggcaagcagaacgacacctgccccaccaagaccagctgctggctggagagcgtgaagagcttcttctacggcctgaagaacatgctgggcggcatcttcggcaacgtgttcctgggcatcttcctgttcctggcccccttcgccctgctgatcctgttcttcttcttcggctggagactgctgttctgcctgaagtgctgcagaagaaccagaggcctgctgaagtacaagcagctgaaggacgaggaggaggccggctacaagaagatcatcgagagactgaacgacaagaagggcaagagcagactgttcgacggcgagagactggccgacagaaagatcgccgagctgttcagcaccaagacccacatcggc

SEQ ID NO: 9194 - RNA, 1932 nt, synthetic construct
  misc_feature 1..1932: note = derived and/or modified CDS sequence (opt4) from CCHFV(Saf)__KX013487.1__Gc
  source 1..1932: mol_type = other RNA
ttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaaggtggaggagggcttcttcgacctgatgcacgtgcagaaggtgctgagcgccagcaccgtgtgcaagctgcagagctgcacccacggcatccccggcgacctgcaggtgtaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacatgaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgtgagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcatcggcatcctgctgttcctggcccccttcgtgctgctggtgctgttcttcatgttcggctggaagatcctgttctgcttcaagtgctgcagaagaaccagaggcctgctgaagtacagacacctgaaggacgacgaggagaccggctacagaagaatcatcgagagactgaacaacaagaagggcaagaacagactgctggacggcgagagactggccgacagaaagatcgccgagctgttcagcaccaagacccacatcggc

SEQ ID NO: 9195 - RNA, 1932 nt, synthetic construct
  misc_feature 1..1932: note = derived and/or modified CDS sequence (opt4) from CCHFV(Ast199)__KX056051.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggc

SEQ ID NO: 9196 - RNA, 1932 nt, synthetic construct
  misc_feature 1..1932: note = derived and/or modified CDS sequence (opt4) from CCHFV(Ast149)__KX056054.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggccctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggc

SEQ ID NO: 9197 - RNA, 1932 nt, synthetic construct
  misc_feature 1..1932: note = derived and/or modified CDS sequence (opt4) from CCHFV(Ast137)__KX056057.1__Gc
  source 1..1932: mol_type = other RNA
ttcctggacagcatcgtgaagggcaccaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagactgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggaggtgagcggcctgaagttcgccagcctggcctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatcttcggctggaagatcctgttctgcttcaagtgctgcagaagaaccagaggcctgttcaagtacagacacctgaaggacgacgaggagaccggctacagaaagatcatcgagagactgaacagcaagaagggcaagaacagactgctggacggcgagagactggccgacagaaagatcgccgagctgttcagcaccaagacccacatcggc

SEQ ID NO: 9198 - RNA, 1932 nt, synthetic construct
  misc_feature 1..1932: note = derived and/or modified CDS sequence (opt4) from CCHFV(Ast133)__KX056060.1__Gc
  source 1..1932: mol_type = other RNA
ttcagcgacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcatcaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctgacctgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcagcttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcagcaagacccacatcggc

SEQ ID NO: 9199 - RNA, 1932 nt, synthetic construct
  misc_feature 1..1932: note = derived and/or modified CDS sequence (opt4) from CCHFV(SK/2015/human)__KX458183.1__Gc
  source 1..1932: mol_type = other RNA
ttcctggacagcatcgtgagaggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcgtgagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccaccagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccagggcagacagtgcagcctgatcgaggccggcaccagattcaacctgggcagcgtgaccatcaccctgagcgagcccagaaacatccagcacaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacagaggcaccatcatcggcaagcagaacaacacctgcatcgccaaggccagctgctggctggagagcgtgaagagcttcttctacggcctgaagaacatgctgagcggcatcttcggcaacctgttcctgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9200 - RNA, 1932 nt, synthetic construct
  misc_feature 1..1932: note = derived and/or modified CDS sequence (opt4) from CCHFV(YL16070)__KY354081.1__Gc
  source 1..1932: mol_type = other RNA
ttcctggacagcatcgccaagggcatgaagagcctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcgtgagctggaacctgggcgtggaggacgccagcgagagcaagaccctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacttcttcaccgactacatgctggtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacgtgcagcagagactgccccccgagatcgtgaccctgcaccccaagatcgaggagggcttcttcgacctgatgcacgtgcagaagatcctgagcgccagcaccgtgtgcaagctgcagagctgcacccacggcgtgcccggcgacttccaggtgtaccacgtgggcaacctgctgagaggcgacaaggtgaacggccacagcatccacaagatcgagccccacttcaacaccagctggatgagctgggacggctgcgacctggactacttctgcaacatgggcgactggcccagctgcacctacaccggcgtgacccagcacaacagagccgccttcatcaacatgctgaacatcgagaccgactacaccaagaccttccacttccacagcaagagagtgaccgcccacggcgacaccccccagctggacctgaaggccagacccgcctacggcgccggcgaggtgaccgtgctggtggaggtggccgacctggagctgcacaccaagaagctggaggtgagcggcctgaagatcgccagcctgacctgcagcggctgctacgcctgcagcagcggcatcagctgcaaggtgagaatccacgtgaacgagcccgacgagttcaccgtgcacgtgagaagcagcgaccccgacgtggtggccgccggcagcagcctgatggccagaaagatcgagttcggcgccgacagcaccttcaaggccttcagcagcatgcccaaggacagcctgtgcttctacatcgtggagaaggactactgcagcagctgcaccgacgacgacacccagaagtgcgtgaacaccaagctggaccacccccagagcatcctgatcgagcacaagggcaccatcatcggcaagcagaacgacacctgcagcaccaagaccagctgctggctgaagagcttcaagggcttcttctacggcctgaagaacatgctgagcggcatcttcggcaacgtgttcctgggcatcctgctgttcctggcccccttcgtgctgctgatcttcttcttcttcttcggctggagactgctgttctgcctgaagtgctgcaagaagaccaagggcctgctgaagtacaagcacctgaaggacaaggaggaggccggctacaagaagatcatcgagagactgaacggcaagaagggcaagagccagctgttcgacggcgagagactggccaacagaaagatcgccgagctgttcagcaccaagatccacatcggc

SEQ ID NO: 9201 - RNA, 1932 nt, synthetic construct
  misc_feature 1..1932: note = derived and/or modified CDS sequence (opt4) from CCHFV(Oman_812956)__KY362518.1__Gc
  source 1..1932: mol_type = other RNA
ttcttcgacagcatcgccaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaaggtggagccccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaacttccacttccacagcaagagagtgaccgcccacggcgacaccccccagctggacctgaaggccagacccaactacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacgccaagctggagagaccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacaagctgctggacggcgagagactggccgacagaaagatcgccgagctgttcagcaccaagacccacatcggc

SEQ ID NO: 9202 - RNA, 1932 nt, synthetic construct
  misc_feature 1..1932: note = derived and/or modified CDS sequence (opt4) from CCHFV(UCCR4405)__KY484029.1__Gc
  source 1..1932: mol_type = other RNA
ttcctggacagcaccgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggagcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcgtggacgtgaaggacctgttcaccgaccacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcagatctaccacatcggcaacctgctgaagggcgacagagtgaacggccacctgatccacaagatcgagccccacttcaacaccagctggatgagctgggacggctgcgacctggactactactgcaacatgggcaactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaaggtggagatcagcggcctgaagttcgccagcctggtgtgcaccggctgctacgcctgcagcagcggcatcagctgcaaggtgagaatccacgtggacgagcccgacgagctgaccgtgcacgtgaagagcagcgaccccgacgtggtggccgccagcaccagcctgatggccagaaagctggagttcggcaccgacagcatcttcaaggccttcagcgccatgcccaagaccagcctgtgcttctacatcgtggagagagagtactgcaagagctgcagcgaggacgacaccaagaagtgcgtggacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgggcagcgtgttcggcaacttcttcgtgggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgagagactggccgacagaaagatcgccgagctgttcagcaccaagacccacatcggc

SEQ ID NO: 9203 - RNA, 1932 nt, synthetic construct
  misc_feature 1..1932: note = derived and/or modified CDS sequence (opt4) from CCHFV(UCCR4401)__KY484035.1__Gc
  source 1..1932: mol_type = other RNA
ttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacagaagaatcgccgagctgttcagcaccaagacccacatcggc

SEQ ID NO: 9204 - RNA, 1932 nt, synthetic construct
  misc_feature 1..1932: note = derived and/or modified CDS sequence (opt4) from CCHFV(UCCR4448)__KY484042.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagaagaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgcaccgccaaggccagctgctggctggagagcgtgaagagcttcttctacggcctgaagaacatgctgagcggcatcttcggcaacgtgttcatcggcatcttcctgttcctggcccccttcatcctgctgatcctgttcttcatgttcggctggaagatcctgttctgcttcaagtgctgcagaagaaccagaggcctgttcaagtacagacacctgaaggacgacgaggagaccggctacagaagaatcatcgagagactgaacaacaagaagggcaagaacaagctgctggacggcgagatcctggccgacagaagaatcgccgagctgttcagcaccaagacccacatcggc

SEQ ID NO: 9205 - RNA, 1932 nt, synthetic construct
  misc_feature 1..1932: note = derived and/or modified CDS sequence (opt4) from CCHFV(U2-2-002/U-6415)__AY900144.1__Gc
  source 1..1932: mol_type = other RNA
ttccaggacagcatcgtgaagggcatgaagaacctgctgaacagcaccagcctggagaccagcctgagcatcgaggccccctggggcgccatcaacgtgcagagcacctacaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagagcttccacttccacagcaagagagtgaccgcccacggcgacaccccccagctggacctgaaggccagacccagctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagttcaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcagcgaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgagcggcatcttcggcaacgtgttcgtgggcatcttcctgttcctggcccccttcatcctgctgatcctgttcttcatgttcggctggagaatcctgttctgcttcaagtgctgcagaagaaccagaggcctgttcagatacaagcacctggagaacgacgaggagaccggctacagaagaatcatcgagagactgaacaacaagaagggcaagaacaagctgctggacggcgagagactggccgacagaagaatcgccgagctgttcagcaccaagacccacatcggc

SEQ ID NO: 9206 - RNA, 1932 nt, synthetic construct
  misc_feature 1..1932: note = derived and/or modified CDS sequence (opt4) from CCHFV(SPU 45/88)__KJ682809.1__Gc
  source 1..1932: mol_type = other RNA
ttcctggacagcatcgtgaagggcaagaagaacctgctgaacagcaccagcctggagaccagcctgagcatcgaggccccctggggcgccatcaacgtgcagagcaccttcaagcccaccgtgagcgccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggactacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcgtgaccctgcaccccagaatcgaggagggcttcttcgacctgatgcacgtgcagaacgtgctgagcgccagcaccgtgtgcaagctgcagagctgcacccacggcgtgcccggcgacctgcagatctaccacatcggcaacctgctgaagggcgacaaggtgaacggccacctgatccacaagatcgagccccacttcaacaccagctggatgagctgggacggctgcgacctggactactactgcaacatgggcgactggcccagctgcagctacaccggcgtgacccagcacaaccacgccgccttcgtgaacatgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctgacctgcaccggctgctacgcctgcagcagcggcatcagctgcaaggtgagaatccacgtggacgagcccgacgagctgaccgtgcacgtgaagagcgaggaccccgacatcgtggccgccagcagcagcctgatggccagaaagctggagttcggcaccgacagcaccttcaaggccttcagcgccatgcccaagaccagcctgtgcttctacatcgtggagagagagtactgcaagagctgcagcaaggaggacacccagaagtgcgtgaacaccaagctggagcagccccagagcatcctgatcgagcacaagggcaccatcatcggcaagcagaacgacacctgcaccgccaaggccagctgctggctggagagcgtgaagagcttcttctacggcctgaagaacatgctgagcggcatcttcggcaacgtgttcatcggcatcctgctgttcctggcccccttcatcatgctgatcctgttcttcatgttcggctggagaatcctgttctgcttcaagtgctgcagaagaaccagaggcctgttcaagtacagacacctgaaggacgacgaggagatcggctacagaaagatcatcgagagactgaacaacaagaagggcaagaacaagctgctggacggcgagagactggccgacagaaagatcgccgagctgttcagcaccaagacccacatcggc

SEQ ID NO: 9207 - RNA, 1932 nt, synthetic construct
  misc_feature 1..1932: note = derived and/or modified CDS sequence (opt4) from CCHFV(SR3)__AJ538199.1__Gc
  source 1..1932: mol_type = other RNA
ttcctggacagcatcgtgaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaaggtgctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgcaccggcgactgccccgagagatgcggctgcaccagcagcacctgcctgcacaaggagtggccccacagcagaaactggagatgcaaccccacctggtgctggggcgtgggcaccggctgcacctgctgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggcagcgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcgtgcccggcgacctgcaggtgtaccacatcggcaacctgctgaagggcgacagagtgaacggccacctgatccacaagatcgagcagcacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaccttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccggcctgacctgcaccggctgctacgcctgcagcagcggcatcagctgcaaggtgagaatccacgtggacgagcccgacgagctgaccgtgcacgtgaagagcgacgaccccgacgtggtggccgccagcagcagcctgatggccagaaagctggagttcggcaccgacagcaccttcaaggccttcagcgccatgcccaagaccagcctgtgcttctacatcgtggagagagagtactgcaagagctgcaacaaggaggacacccagaagtgcgtgaacaccaagctggagcagccccagagcatcctgatcgagcacaagggcaccatcatcggcaagcagaacaacacctgcaccgccaaggccagctgctggctggagagcgtgaagagcttcttctacggcctgaagaacatgctgggcggcatcttcggcaacgtgttcatcggcatcttcaccttcctgacccccttcatcctgctgatcctgttcttcatgttcggctggagaatcctgttctgcttcaagtgctgcagaagaaccagaggcctgttcaagtacagacacctgaaggacgacgaggagaccggctacagaaagatcatcgagagactgaacaacaagaagggcaagaacagactgctggacggcgagagactggccgacagaaagatcgccgagctgttcagcaccaagacccacatcggc

SEQ ID NO: 9208 - RNA, 4656 nt, synthetic construct
  misc_feature 1..4656: note = derived and/or modified CDS sequence (opt4) from DUGV(ArD44313)__NC_004158.1__GP
  source 1..4656: mol_type = other RNA
atgagcaagagagtgctgatcatcgccgtggtggtgtacctggtgttcaccacccagaaccagatcaccggcaaccacaccaccatcaacagcagcagccccagcaccaccgaggccagcagcacccccaccgtgagcagaaccccccagaccaccaccaccagcaccgccgtgagcaccaccatcaccgccaccaccacccccaccgccagctggaccacccagagccagtacttcaacaagaccacccagcaccactggagagaggagaccatgatcagcagaaaccccaccgtgctggacagacagagcagagccagcagcgtgagagagctgctgaacaccaagttcctgatgctgctgggcttcatccccaagggcgaggtgaaccacctggagaacgcctgcaacagagagggcaagaactgcaccgagctgatcctgaaggagagaatcgccagattcttcagcgagaccgagaaggagagctgctacaacacctacctggagaagcacctgagaagcgtgagccccgaggtgagcctgaccccctacagagtgctgggcctgagagaggacatcctgctgaaggagatcgacagaagaatcatcagattcgagaccgacagccagagagtgacctgcctgagcgccagcctgctgaagcccgacgtgttcatcagagagcagagaatcgacgccaagcccagcaacggccccaagatcgtgcccgtggacagcgtggcctgcatgaacctggaggccaacgtggacgtgagaagcaacaagctggtgatccagagcctgatgaccaccgtgaagatcagcctgaagaactgcaaggtggtggtgaacagcagacagtgcatccaccagcagaccggcagcggcgtgatcaaggtgcccaagttcgagaagcagcagggcggcacctggagcagctacatcgccggcgtgtacaccgccaccatcgacctgctggacgagaacaaccagaactgcaagctgttcaccgagtgcatcgtgaagggcagagagctggtgaagggccagagcgagctgaagagcttcaacatcgaggtgctgctgcccagagtgatgaagaccagaagaaagctgctggccgtgaccgacggcagcaccgagtgcaacagcggcacccagctgatcgagggcaagagcatcgaggtgcacaagcaggacatcggcggccccggcaagaagctgaccatctgcaacggcaccagcgtgctggacgtgcccctggacgagggccacggctgctacaccatcaacgtgatcaccagcaagagagcctgcagacccaagaacagcaagctgcagtgcagcatcgacaaggagctgaagccctgcgacagcggcaagtgcctgagcatcagccagaagggcgccggccacatcaaggtgagcagaggcaagaccatcctgatcaccgagtgcaaggagcactgccagatccccgtgcccaccggcaagggcgacatcatggtggactgcagcggcggcagacagcactacctggaggtgaacatcgtggacatccactgccccaacaccaagttcctgggcggcatcatgctgtacttctgcagaatgagcagcagacccaccgtggccctgctgctgggcatctggatcggctgcggctacatcctgacctgcatcttcagcttcctgctgtaccacctgatcctgttcttcgccaactgcatcaagcagtgcagaaagaagggcgagagactgggcgagatctgcgtgaagtgcgagcagcagaccgtgaacctgatggaccaggagctgcacgacctgaactgcaacttcaacctgtgcccctactgctgcaacagaatgagcgacgagggcatgagcagacacgtgggcaagtgccccaagagactggagagactgaacgagatcgagctgtacctgaccaccagcgagtgcctgtgcctgagcgtgtgctaccagctgctgatcagcgtgggcatcttcctgaagagaaccacctggctggtggtgctgctggtgctgctgggcctggccatcagccccgtgcagggcgcccccaccgaggtgagcaacgtgaagcaggacggcgactacagcatctgctacttcatcttcggctgcctggtgaccgccgccctgctgctgaaggtgaagagaaccaacagcaacggcatcgtggtggtggtggacagcttcggcagatgcccctactgcaacgagttcaccgacagcctgttcgaggaggtgctgcacgacaccctgtgcagcctgtgcgtgtgccccttctgcgagaagcaggccctggacctggtgaccctggaggagcacgtgaaggagtgctacaaggtggccaccagaaaggacatcttcaagatcctgggcagaaagttcaccaacgccctggtgagaagagagaagctgttcaccaccggcctgcagctgttcatcaacaagaccaacgtggtggtgttcgccctgatcatgtgcttcctgctgctgctgaccggccacaacgccagcgccttcgacagcggcgacctgcccgacggcgtgtgggaggagagcagccagctggtgaagagctgcacccagttctgctacatcgaggaggacgtgtgctactgccccgccgaggacggcgtgggcagaaagctgctgttcttcaacggcctgcagaacagcgtgaagagactgagcgacagccacaagctgctgaccagcgtgagcatcgacgccccctggggcagaatcaacgtggagagcacctggaagcccaccctggccgccagcaacatcgccatgagctggagcagcaccgacatcaagggcgagaaggtgatcctgagcggcagaagcaccagcatcatcaagctgaaggagaagaccggcgtgatgtggaagctggtgggcagcggcctggccagcgagaagaagaagcccttcagattccccatcatggacttcgcccaggtgtacaacagcgtgttccagtacatcaccggcgacagactgctgagcgagtggcccaaggccgtgtgcaccggcgactgcccccacagatgcggctgccagaccagcacctgcatggccaaggagtgccacacccaggagtgcgtgagcacccacatggtgctgggcatcggcaccggctgcacctgctgcggcatggacgtggagagacccttcaacaagtacctgggcgtgaagtggagcaccgagtacctgagaaccgaggtgctggtgtgcgtggaggtgaccgaggaggagagacactgcgagatcgtggaggccggcaccagattcaacatcggccccatcaccatcaccatcagcgacccccagaacatcggcagcaagctgcccgagagcctgatgaccgtgcaggagatcgacgacagcaacttcgtggacatcatgcacgtgggcaacgtgatcagcgccgacaacagctgcagactgcagagctgcacccacggcagcgccgtgaccaccagattcaccgccctgaccgccctgatcaaggacgaccacagcagcggcctgaacctggccgtgctggaccccaaggtgaacagcagctggctgagctgggagggctgcgacatggactactactgcaacgtgggcgactggcccacctgcacctacaccggcgtggtgacccagaagctgagagagttcctgaagctggaccagcacagaaagagactgcacaccaccctgagcttcagcctgaagaagaacctgagcaagagaagccacaccagcgtgagactggagggcaagaccgtgaccagaatggaggtgaaggtgaccgccctgatcgaggtggacggcatggagctgcacagcaagaccatcagactgagcggcatcagactgaccggcctgaagtgcagcggctgcttcagctgcaccagcggcatcagctgcagcgtgaacgccaagctgaccagccccgacgagttcaccctgcacctgagaagcaccagccccaacgtggtggtggccgagaccagcatcatcgccagaaagggccccagcgccaccaccagcagattcaaggtgttcagcgtgagagacaccaagaagatctgcttcgaggtggtggagagagagtactgcaaggactgcacccccgacgagctgaccacctgcaccggcgtggagctggagcccaccaaggacatcctgctggagcacagaggcaccatcgtgcagcaccagaacgacacctgcaagagcaagatcgactgctggagcaacagcatcagcagcttcgccagcggcatcggcgacttcttcaagcactacatcggcagcatcgccgtgggcgtgctgggcaccgtgctgcccttcgccctgctgatcctgttcttcatctacggcgacaagatgctgtggcccttcaaggtgttctgcagaccctgcagaagatgctgcagaaagaacgagggctacaacaagctggccgaggaggaggagctgagagacatcatcagaaagttcagcaagagcggcgagctgatcaacaaggacgccaaggacaagagaaccctggccagactgttcatgagcgacaaccccaagctgaagaaggagaagaagctgagcgagatcgcctga

SEQ ID NO: 9209 - RNA, 4656 nt, synthetic construct
  misc_feature 1..4656: note = derived and/or modified CDS sequence (opt4) from DUGV(IbAr1792)__KU925456.1__GP
  source 1..4656: mol_type = other RNA
atgagcaagagagtgctgatcatcgccgtggtggtgtgcctggtgttcaccacccagaaccagatcgccggcaaccacaccaccgccaacagcggcagccccagcaccaaggaggccagcagcatgcccaccgtgagcgacaccccccagaccaccaccaccagcaccgccgtgagcaccaccatcaccgccaccaccacccccaccgccagctggaccacccagagccagtacttcaacaagaccacccagcaccactggagagaggagaccatggtgagcagaaaccccaccgtgctgaacagacagagaagagccagcagcgtgaaggagctgctgaacaccaagttcctgatgctgctgggcttcatccccaagggcgaggtgaaccacctggagaacgcctgcaacagagagggcaagaactgcaccgagctgatcctgaaggagagaatcgccagattcttcagcgagaccgagaaggagagctgctacaacacctacctggagaagcacctgtgcagcgtgagccccgaggtgagcctgaccccctacagagtgctgggcctgagagaggacatcctgctgaagaagatcgacagaagaatcatcagattcgaggccgacagccagagagtgacctgcctgagcgccagcctgctgaagcccgacgtgttcatcagagagcagagaatcgacgccaagcccagcaacggccccaagatcgtgcccgtggacagcgtgagatgcatcaacctggaggccaacgtggacgtgagaagcaacaagctggtgatccagagcctgatgaccaccgtgaagatcagcctgaagaactgcaaggtggtggtgaacagcagacagtgcatccaccagcagaccggcagcggcgtgatcaaggtgcccaagttcgagaagcagcagggcggcacctggagcagctacatcgccggcgtgtacaccgccaccatcgacctgctggacgagaagaaccagaactgcaagctgttcaccgagtgcatcgtgaagggcagagagctggtgaagggccagagcgagctgaagagcttcaacatcgaggtgctgctgcccagagtgatgaagaccagaagaaagctgctggccgtgaccgacggcagcaccgagtgcaacagcggcacccagctgatcgagggcaagagcatcgaggtgcacaagcaggacatcggcggccccggcaagaagctgaccatctgcaacggcaccagcgtgctggacgtgcccctggacgagggccacggctgctacaccatcaacgtgatcaccagcaagagagcctgcagacccaagaacagcaagctgcagtgcagcatcgacaaggagctgaagccctgcgacagcggcaagtgcctgagcatcagccagaagggcgccggccacatcaaggtgagcagaggcaagaccatcctgatcaccgagtgcaaggagcactgccagatccccgtgcccaccggcaagggcgacatcatggtggactgcagcggcggcagacagcactacctggaggtgaacatcgtggacatccactgccccaacaccaagttcctgggcggcatcatgctgtacttctgcagaatgagcagcagacccaccgtggccctgctgctgggcatctggatcggctgcggctacatcctgacctgcatcttcagcttcctgctgtaccacctgatcctgttcttcgccaactgcatcaagcagtgcagaaagaagggcgagagactgggcgagatctgcgtgaagtgcgagcagcagaccgtgaacctgatggaccaggagctgcacgacctgaactgcaacttcaacctgtgcccctactgctgcaacagaatgagcgacgagggcatgagcagacacgtgggcaagtgccccaagagactggagagactgaacgagatcgagctgtacctgaactacaagagagtgcccagctgcctgagatgcatgctgagcaccagcatcagcgtgggcatcttcctgaagagaaccacctggctggtggtgctgctggtgctgctgggcctggccatcagccccgtgcagggcgcccccgccgaggtgagcaacgtgaagcaggacggcgactacagcatctgctacttcatcttcggctgcctggtgaccgccgccctgctgctgaaggtgaagagaaccaacagcaacggcatcgtggtggtggtggacagcttcggcagatgcccctactgcaacgagttcaccgacagcctgttcgaggaggtgctgcacgacaccctgtgcagcctgtgcgtgtgccccttctgcgagaagcaggccctggacctggtgaccctggaggagcacgtgaaggagtgctacaaggtgaccaccagaaaggacatcttcaagatcctgggcagaaagttcaccaacgccctggtgagaagagagaagctgttcaccaccggcctgcagctgttcatcaacaagaccaacgtggtggtgttcgccctgatcatgtgcttcctgctgctgctgaccggccacaacgccagcgccttcgacagcggcgacctgcccgacggcatctgggaggagagcagccagctggtgaagagctgcacccagttctgctacatcgaggaggacgtgtgctactgccccgccgagaacggcgtgggcagaaagctgctgttcttcaacggcctgcagaacagcgtgaagagactgagcgacagccacaagctgctgaccagcgtgagcatcgacgccccctggggcgccatcaacgtggagagcacctggaagcccaccctggccgccagcaacatcgccatgagctggagcagcaccgacatcaagggcgagaaggtgatcctgagcggcagaagcaccagcatcatcaagctgaaggagaagaccggcgtgatgtgggagctgggcagcgagctggccagcgagaagaagaagctgctggtgagcatcatggacttcgcccaggtgtacaacagcgtgttccagtacatcaccggcgacagactgctgagcgagtggcccaaggccgtgtgcaccggcgactgcccccacagatgcggctgccagaccagcacctgcatggccaaggagtggccccacaccagaaactggagatgcaaccccacctggtgctggggcatcggcaccggctgcacctgctgcggcatggacgtggagagacccttcaacaagtacctgggcgtgaagtggagcaccgagtacctgagaaccgaggtgctggtgtgcgtggaggtgaccgacgaggagagacactgcgagatcgtggaggccggcaccagattcaacatcggccccatcaccatcaccatcagcgacccccagaacatcggcagcaagctgcccgagagcctgatgaccgtgcaggagatcgacgacagcaacttcgtggacatcatgcacgtgggcaacgtgatcagcgccgacaacagctgcagactgcagagctgcacccacggcagcgccggcgactaccagatctacagcaccgacagcctgatcaaggacgaccacagcagcggcctgaacctggccgtgctggaccccaaggtgaacagcagctggctgagctgggagggctgcgacatggactactactgcaacgtgggcgactggcccacctgcacctacaccggcgtggtgacccagaacagcgagagcttcagcaacctgatcaacatcgagaaggactacacccagagattccacttccacagcaagagaatcagcgccaagggccacaccctgcagctggacctgaaggccagacccaaccaggacggcggcgaggtgaccgccctgatcgaggtggacggcatggagctgcacagcaagaccatcagactgagcggcatcagactgaccggcctgaagtgcagcggctgcttcagctgcaccagcggcatcagctgcagcgtgaacgccaagctgaccagccccgacgagttcaccctgcacctgagaagcaccagccccaacgtggtggtggccgagaccagcatcatcgccagaaagggccccagcgccaccaccagcaagttcaaggtgttcagcgtgagagacaccaagaagatctgcttcgaggtggtggagagagagtactgcaaggactgcagccccgacgagctgaccacctgcaccggcgtggagctggagccccccaaggacatcctgctggagcacagaggcaccatcgtgcagcaccagaacgacacctgcaagagcaagatcgactgctggagcaacagcatcagcagcttcgccagcggcatcggcgacttcttcaagcactacatcggcagcatcgccgtgggcatcctgggcaccgtgctgcccttcgccctgctgatcctgttcttcatctacggcgacaagatgctgtggcccttcaaggtgttctgcagaccctgcagaagatgctgcagaaagaacgagggctacaacaagctggccgaggaggaggagctgagagacatcatcagaaagttcagcaagagcggcgagctgatcaacaaggacgccaaggacaagagaaccctggccagactgttcatgagcgacaaccccaagctgaagaaggagaagaagctgagcgagatcgcctga

SEQ ID NO: 9210 - RNA, 4884 nt, synthetic construct
  misc_feature 1..4884: note = derived and/or modified CDS sequence (opt4) from NSDV(Jilin)__NC_034391.1__GP
  source 1..4884: mol_type = other RNA
atggtgagcctggagaagggcctgatcctgctgctgctgatgcacatcgccatcgccagcaccggcggcagcctgggcctgcccggcctgaacggcgaggaccacaccgacgaccccgaggtgggcggcgacggccccaccgaggagtacaccgaggacgaccccgagagcaccaccgtgagcatccccaccaccccccccgtgctgggccagggcaccgaggaggtgcccgccaccagcggcgaggccgaggccggctacagcaccaccgacgtgcccgacaccgtgagcgagaaggtggaggacgagcaggacaccacccccagcacccaggtgacccccgaccagcccgagcagagcaccaccagcctgcccgacccctggaccgccatcagcaccagaatcggcagagagctgctgagcgtggagagcgacaccaccaagagcagcctggtgaccgtgggccacccccagcagcccatcttcctggacggccagcccgtggaggaggtgacccaccccgtgaacgagagagacgtgaccgaggccctgagaaagtacgacaagatgaagaagctgctgagccagagaatcctgagcaagatgggcatggccagagacttcaccgacgaggagctggacgtgtggtgccacgagagattcgacaactgcagcagcaacgacatcgagaacagaatcagagacttcttcctgatcagcgaccagaccgagtgcttcgacgaggtgctggtgaagagactgtgcgagagcaccaaccccatcgtgggcgagccctggcaggtggccggcatcaaggaggagatcgtgagaagagagatgggcagaagaatcttcagattcttcacccccaccctgaaggtgacctgcgtgagcggcagcctgaaccccagcgaccagttcgtgagattctacgaccccgtgatcgagagaaccagcggccccaccatccagaactacgacagcatgcactgcctgaacatcgagaacggcctggccaagcccagcaagatggtggtgctgaacgtgctgatgaccaccgtggaggtgagactggagagctgcagagccttcatcaacgcccaccagtgcatctacacccagcacgccgacggccaggtgatggtgcccaccttcgtggaccacagcggcaccagaagaaccatcggcgcctacaccatgagcttcaacctgaccgacgagagaaacagagcctgcatcatcagaaccacctgcgtggtgaagggcaaggaggtgaagaagggccagagccagctgagaggcttccccaccagcatcagactgttcaagagcgtgaccggcaagagaagactgatggccgaggagggcgactggaccgactgcggcagcggcacccagctggacatgaccatggccgtgagcgtgcacaacgacaagaagggcggccccggcaagaagctgaccatctgcaacggcaccaccgtgagcgacagcaccctgaacgagggcctgggctgctacaccatcaacaaggtgatcaccggcaaggcctgcaaggtgggcaacagcaccggcagctgcgaggtgcagaccgagctgcagaagtgcgagaccggcaagtgcatcctggtgaagcagaagagcaagggcgtggtgaagctgaagagaggcaagaccgtgatcatcaccgagtgccagggcagctgcctgttcgccatcccccaggacaccggcgacatcaccatcgactgcagcggcggcagacagcactacctggagatcaacatcgtggacatccactgccccggcaaggacaagtggaagggcttcatgctgtacatctgcagagtgagcagcagacccctgatcgccctgaccttcggcctgtggctggccgccggctacctgatcacctgcctggtgagcttcatcatctacaacgccgtgctgctgctgagcatcgccatcaagaaggtgagacagggcagagagaagaagggcgacctgtgcatcaagtgcgagcagcactgcatgaacctgtacgaccaggagctgcacgagctgaactgcagcttcaacctgtgcccctactgcgccaacagactgagcgacgagggcctgcccagacacgtgcccagatgccccaagaagagcgagagactggaggagatcgagctgtacatcaactacaccagagtgccctgcatcctgagatggatcctgagcaccagcgtgcaggtgggcaccgccgtgaagagactgagctggttcagcgtgctggtgaccctgttcatcctgaccatcagccccgtgcagggcttccccctggagagcccccccatcggcgccgccaccgacagcagaatcatgtacggcgtggtgggcttcatgttcgccctgatcatgatgctgaacctgaagaagagccactacggcagcatcttccacgtgatcgacggcttcggcagatgcaacctgtgcgacaccagaatcgacagcctgatggaggagaccgcccacgacctgtgctgcatgttcgactgctgcccctactgccacagagtgagcgagagcaacggcagccactgcttccacgtgagaatctgcgtggccaaggagatcagcaagaagatgctgaaggccggcggcagactgttcaccaacaagctggtgagcagagagggcaccttcgccaacagaatccagctgctgtacagaagaagcaaggtggtgagcaccctggtggtgaccgtgctgctgctgctggtgctgctgaagcccaccaccgccttcgacagcggccccctgcccgacggcacctgggaggaggaggagaagctggtgagaaactgcggccaggagtgcatcctggaccagggcgagtgcctgtgccccggcgagcacagagccggcagaaagctgctgttcctgaacggcctgcaggacgccgccagaagaatgaccgagagccacagactgctgaccagcgtgagcatcgacgccccctggggcgccatcaacatcgagagcaccttcaagcccgtgctggccgccagcaacatcgacctgagctggaacagcgccgaggagcagggcgacaagatcatcctgagcggcagaagcaccggcatcatcaagctgcaggagagaaccggcctgatgtggaagatgagcagcgagaaggccagcgagagcaagaacctgctggtgagcgtgatggacttcagccagctgtacaacagcatcttccagtacatcaccggcgacagaagcctgagcgagtggcccaaggccgtgtgcaccggcgactgccccgacagatgcggctgccagaccagcacctgctaccacaaggagtggccccacaccagaaactggagatgcaaccccacctggtgctggggcatcggcaccggctgcacctgctgcggcatggacgtggagagatacttcaacaagtacttcggcgtgaagtgggccctggagtacgtgagaaccgacgtggtggtgtgcgtggagctgaccaacgaggagagacactgcgacctggtgcaggccggcagcagattcagcatcggccccgtgagcgtgaccctgagcgacccccagaacgtggtgaacagactgagcagcaacatcatgaccatccaggagatcgccgacaacggcatcctggacctgatgcacgtgagcaaggtgatcagcgccgagaacgcctgcaagctgcagagctgcacccacggcagccccggcgacctgcagatcctgcacaccgacaacctgatcaagggcgacatgagcggcggcatcaacctggcccacctggacccccaggtgaacaccagctggatgagctgggagggctgcgacctggactactactgcaccgtgggcgactggcccagctgcacctacaccggcgtgaacagcatcaacaccgacagcttcaccaacctgatcaacaccgagaccgactacaccggcaagttccacttccacagcaagagaatcagcgccagagacgacaccctgcagatggacctgaaggccagacccaacagcggcggcggcgagatgaccgtgctggtggaggtgaacggcctggagctgcacagcaagagaatcagcctgaagggcctgagactgaccaacctgaagtgcgacggctgcttcgcctgcagccagggcctgacctgcaccatcaccgccaagctggagagccccgacgagttcaccatccacctgagaagcaccagcagagacgtggtggtggccgagaccagcgtgaccgccagaaaggtggagaccggcgccagaagcggcttcagagccttcgccgtgagagacgtgaagaagctgtgcctggaggtggtggagaaggactactgccccagctgcaccgtggaggacctgaagatctgcgtggacgtgagcctggagccccccaaggacatcctgatcgagcacaagggcaccatcatccagcactacaacaagagctgcgacgagggctacaactgctgggtgggcagcgtgagcggcttcttcgtgggcgtgaaggacttcttcgagaagaacctgggcggcgtgctgatcggcctggtgagcaccatcctgcccctggtgctgaccgtgctgttcttcatctacggcaagaagctgttctgcctgtgcagactgtgccacaagaagtgctgcagaggcagcggcagaggcagagacggctacagcagactgagccaggaggaggagatcaaggagatcatcaagaagttcagcagaaacggcgagctgctgggcaagggcgagaacgacaagagaaccgtggccagaatgttcatggacggccagagcaccaagaaggccatcaaggaggtggcctga

SEQ ID NO: 9211 - RNA, 4884 nt, synthetic construct
  misc_feature 1..4884: note = derived and/or modified CDS sequence (opt4) from NSDV(708)__EU697952.1__GP
  source 1..4884: mol_type = other RNA
atggtgagcctggagaagggcttcttcttcctgctgctgctgcacatcgtgaccgccagcaccggcggcccccccggcctgcccggccccaacggcaaggaccagaccgacggccccgagggcggcggcgacggccccaccgaggagtacaccgaggacgacttcgagagcaccaccttcagcatccccaccaccccccccgtgagcgagcaggacgccaaggaggtgagcgccaccagcgaggaggccgaggtggaggacagcaccctgatcgtgcccaagaccatgagcgagaaggtgggcgacgagcagagcaccaccagcaacatgcaggtgaccaccagccagcccgagcagagcaccaccggcatgcccggcccctggatggccagcagcatcaagatcggcagagagctgctgagcgtggagagcgacaccaccaagagcagcctggtgaccgtgggctacccccagcagcccatcttcctggacggccagcccgtggaggaggtgacccaccccgtgagcgagagagacgtggccgaggccctgagaaagtacgacaagatgaagaagctgctgagccagagaatcctgagcaagatgggcatggccagagacttcaccgacgacgagctggacgcctggtgccacgagagattcgacaactgcagcagcaacgacatcgagaacagaatcaaggacttcttcctgatcagcgaccagaccgagtgcttcgacgaggtgctggtgaagagactgtgcgagagcaccaaccccatcatcggcgagccctggcaggtggccggcatcaaggaggaggtggtgagaagagagatgggcagaagaatcttcagattcttcacccccaccctgaaggtgacctgcgtgagcggcagcctgaaccccagcgaccagttcgtgagattctacaaccccgtgatcgagagaaccagcggccccaccatccagaactacgacagcatgcactgcctgaacatcgagaacggcctgatcaagcccagcaaggtggtgatcctgaacgtgctgatgaccaccgtggaggtgagactggagagctgcagagccttcgtgaacgcccaccagtgcatctacacccagcacgccgacggccaggtgagagtgcccaccttcgtggaccacagcggcaccaagagaaccatcggcgcctacaccatgagcttcaacctgaccgacgagagaaacaaggcctgcatcatcagaaccacctgcgtggtgaagggcaaggaggtgaagaagggccagagccagctgagaggcttccccaccagcatcagactgttcaagagcgtgaccggcaagagaagactgatggccgaggagggcgactggaccgactgcggcagcggcacccagctggacatgaccaccgccgtgagcgtgcacaacgacagaaagggcggccccggcaagaagctgaccatctgcaacggcaccaccgtgagcgacagcaccctgaacgagggcctgggctgctacaccatcaacaaggtgatgaccggcaaggcctgcaaggtgggcaacagcaccggcagctgcgaggtgcagcccgagctgcagaagtgcgagaccggcaagtgcatcctggtgaagcagaagaacaagggcgtggtgaagctgaagagaggcaagaccgtgatcatcaccgagtgccagggcagctgcctgttcgccatcccccaggacaccggcgacatcaccatcgactgcagcggcggcagacagcactacctggaggtgaacatcgtggacatccactgccccggcaaggacaagtggaagggcttcatgctgtacatgtgcagagtgagcagcagacccctgatcgccctgaccttcggcctgtggctggccgccggctacctgatcacctgcctggtgagcttcatcatctacaacgccgtgctgctgctgagcatcgccatcaagaaggtgagacagggcagagagagaaagggcgacctgtgcatcaagtgcgagcagcactgcatgaacctgtacgaccaggagctgcacgagctgaactgcagcttcaacctgtgcccctactgcgccaacagactgagcgacgagggcctgcccagacacgtgcccagatgccccaagaagaccgagagactggaggagatcgagctgtacatcaactacaccagagtgccctgcatcctgagatggatcctgagcaccagcgtgcaggtgggcaccgccgtgaagagactgagctggttcagcgtgctggtgatcctgttcgtgctgaccatcagccccgtgcagggcttccccctggagaacacccccatcggcagcaccaccgacagcagaatcatctacggcgtggtgggcttcatcttcgccctgatcatgatgctgaacctgaagaagagccactacggcagcatcttccacgtgatcgacggcttcggcagatgcaacctgtgcgacaccagaatcgacagcctgatggaggagaccgcccacgacctgtgctgcatcttcgactgctgcccctactgccacagagtgagcgagagcaacggcagccactgcttccacgtgagaatgtgcgtggccaaggagatcagcaagaagatgctgaaggccgccggcagactgttcaccaacaagctggtgagcagagagggcatcttcgccaacagagtgcagctgctgtacagaagaagcaaggtggtgagcaccttcgtggtgaccgtgctgctgctgctggtgttcctgagacccgccaccgccttcgacagcggccccctgcccgacggcacctgggaggaggaggagagactggtgagaaactgcggccaggagtgcgtgctggaccaggacgagtgcctgtgccccggcgagaacagagccggcagaagactgctgttcctgaacggcctgcaggacgccgtgagaagaatgaccgagagccacagactgctgaccagcgtgagcatcgacgccccctggggcgccatcaacatcgagagcaccttcaagcccgtgctggccgccagcaacatcgacctgagctggaacagcgccgaggagcagggcgacaagatcatcctgagcggcagaagcaccggcatcatcaagctgcaggagagaaccggcctgatgtggagaatgagcagcgagaaggccagcgagagcaagaacctgctggtgagcgtgatggacttcagccagctgtacaacagcatcttccagtacatcaccggcgacagaagcctgagcgagtggcccaaggccgtgtgcaccggcgactgccccgacagatgcggctgccagaccagcacctgctaccacaaggagtggccccacaccagaaactggagatgcaaccccacctggtgctggggcatcggcaccggctgcacctgctgcggcatggacgtggagaagtacttcaacaagtacttcggcgtgaagtgggccctggagtacgtgagaaccgacgtggtggtgtgcgtggagctgaccaacgaggagagacactgcgacctggtgcaggccggcagcagattcagcatcggccccgtgagcgtgaccctgagcgacccccagaacgtggtgaacagactgagcagcaacatcatgaccatccaggagatcgccgacaacggcatcctggacctgatgcacgtgagcaaggtgatcagcgccgagaacgcctgcaagctgcagagctgcacccacggcagccccggcgacctgcagatcctgcacaccgacaacctgatcaagggcgacatgagcggcggcatcaacctggcccacctggacccccaggtgaacaccagctggatgagctgggagggctgcgacctggactactactgcaccgtgggcgactggcccagctgcacctacaccggcgtgaacagcatcaacaccgacagcttcaccaacctgatcaacaccgagaccgactacaccagcaagttccacttccacagcaagagaatcagcgccagagacgacaccctgcagatggacctgaaggccagacccaacaccggcggcggcgagatgaccgtgctggtggaggtgaacggcctggagctgcacagcaagagaatcaacctgaagggcctgagactgaccaacctgaagtgcgacggctgcttcgcctgcagccagggcctgacctgcaccgtgatcgccaagctggtgagccccgacgagttcaccatccacctgagaagcaccagcagagacgtggtggtggccgagaccagcatcaccgccagaaaggtggacaccggcgccagaagcagcttcagagccttcgccgtgagagacgtgaagaagctgtgcctggaggtggtggagaaggactactgccccagctgcaccgtggacgacctgaagatgtgcgtggacgtgagcctggagccccccaaggacatcctgatcgagcacaagggcaccatcatccagcactacaacaagagctgcgacgagggctacaactgctgggtgggcagcgtgagcggcttcttcgtgggcgtgaaggacttcttcgagaagaacctgggcggcgtgctgatcggcctggtgggcaccatcctgcccctggtgctgaccatcctgttcttcatctacggcaagaagctgttctacctgtgcagactgtgccacaagaagtgctgcaagggcagcggcagaggcagagacggctacagcagaatcagcagagaggaggagatcaaggagatcatcaagaagttcagcagaaacggcgagctgctgggcaagggcgagaacgacaagagaaccgtggccagaatgttcatggacggccagagcaccaagaaggccatcaaggaggtggcctga

SEQ ID NO: 9212 - RNA, 4875 nt, synthetic construct
  misc_feature 1..4875: note = derived and/or modified CDS sequence (opt4) from NSDV(779)__HQ286599.1__GP
  source 1..4875: mol_type = other RNA
atggccctggtggccaagggcctgatcctgatgctgctgctgtacatgttcaaggccagcgaggtgaacctggagctgcccagctggaacagcaccgagggcaccgagtacgccgacgagctgcccaccgagccccccagcgaggaggagcccaagctggccgccgtgagcaccgtgaccacccccgccccccccaaggagagcaccgaggacaccatcgagagccccgacggcggcgagaccatggcccccaccacccccgcccccgtgaccgacagcgccagcaagctggaggaggagcccggcaccacccagcaggcccagagcacccagatgcagaacagccaggcccccatcggcatgcccgaggcctggagcaccagccccagcagagtgggcagaaagcccctgagcgccagccccgacgtgagcgagcccgaccagaacaccgaggcccagacccacccccccgtgttcctggacggcagacccgtggaggaggaggagcacagcgtgggcaccagagacgtggccagcgacctgagagagtacaaccagatgaagcagctgctgagccagagaatcctggccaagatgggcatggccgtggacttcaccgacgacgagctggacacctggtgctacagaagatacagcaactgcagcagcaacgacatcgagagcagaatcagagacttcttcctgatcaccgacagaagcgagtgcttcgacgaggtgctggtgaagagactgtgcgagaccaccagccccatcatcgacagagcctggaagatcgccggcctgaaggaggaggtggtgctgagagagatgggcagaagaatcttcagattcttcacccccgccctgaaggtgacctgcatgagcggcagcctgaaccccagcaaccagttcgtgagattctacaaccccaccctggagagaaccagcggccccaccatccagaactacgacggcatgcactgcctgaacatcgagaacggcctgatcaagcccagcaaggtggtggtgatcaacgtgctgatgaccaccgtggacatcagactggagagctgcagagccttcatcaacgcccagcagtgcacctacacccagcacgccgacggcctggtgagagtgcccaccttcgtgggcccccacggcgagaagagaatcatcggcgcctacaccatgagcttcaacctgaccgacgagaagaacaaggcctgcaccatcaagaccacctgcgtggtgaagggcaaggaggtgaagaagggccagagccagctgagaggcttccccaccaccatcagactgttcaagagcgtgaccggcaagagaagactgatgagcaacgaggaggagtggaccgagtgcggcagcggcacccagctgaacatggccaccgccgtgagcgtgcacaacgacaagctgggcggccccggcaagaagctgaccatctgcaacggcaccaccgtgagcgacatcgccctgaacgagggcctgggctgctacaccatcaacaagatcatcaccggcaaggtgtgcaagaccggcaacaccaccggcagctgcgaggtgcagcccgagctgcagaagtgcgagaccggcaagtgcatcctgatcaagcagaagaacaagggcgtggtgaagctgaagagaggcaagaccgtgatcatcaccgagtgccagggcagctgcctgttcgccatcccccaggacaccggcgacatcaccatcgactgcagcggcggcagacagcactacctggagatcaacatcgtggacatccactgccccggcaaggacaagtggaagggcttcatgctgtacatctgcagagtgagcagcagacccctggtggccctgaccttcggcatctggctgaccgccggctacctgatcacctgcctggccagcttcatcctgtacaacgccatcctgctgatcagcatcgccatcaagaagctgaagcagaagagagagaagaagggcgacctgtgcatcaagtgcgagcagcactgcatgaacctgtacgaccaggagctgcacgagctgaactgcagcttcaacctgtgcccctactgcgccaacagactgagcgacgacggcctgcccagacacgtgcccagatgccccaagagaggcgagagactggaggagatcgagctgtacatcaactacaccagagtgccctgcctgctgagatgggccctgagcaccagcgtgcaggtgggcaccgtgatcaagagactgagctggttcggcgtgctgctgaccctgttcttcctgaccatcagccccgtgcagggcttccccctggagaacccccccatcggcaccgccaccgacagcaacatcatctacggcctggccggcttcatcttcgccctggtgctgatgctgaacctgaagaagacccactacggcagcgtgttccacgtgatcgacggcctgggcctgtgcagcctgtgcgacaccagaatcgacagcctgatggaggagaccgcccacgagctgtgctgcgccttcgactgctgcccctactgccaccaggtgagcgagagcaacggcagccactgcttccacatgagaatctgcgtgagcaaggagatcagcaagaagatgctgaaggccgccggcaagctgttcaccaacaagctggtgagcagagagggcttcttcgccaacaagatccagctgctgtaccagagaagcaaggtggtgagcaccctgatcctgaccgtgctgctgctgctgatcatcctgaagcccgccgccgccttcgacagcggccccctgcccgacggcacctgggaggaggaggagagcctgatcagaagctgcgaccaggagtgcgtgctggagcaggacgagtgcctgtgccccggcgagcacagagccggcagaagactgctgttcctgagcggcctgcaggacgccgccagaagaatgaccgagagccacagactgctgaccagcgtgagcatcgacgccccctggggcgccatcaacatcgagagcaccttcaagcccctgctggccgccagcaacatcgacctgagctggaacagcgccgaggagcagggcgacaagatcgtgctgagcggcagaagcaccggcatcatcaagctgcaggagagaaccggcctgatgtggaagatgagcagcgagaaggccagcgagagcaagaacctgctggtgagcatcatggacttcagccagctgtacaacagcatcttccagtacatcaccggcgacagaagcctgagcgagtggcccaaggccgtgtgcaccggcgagtgccccgacagatgcggctgccagaccagcacctgctaccacaaggagtggccccacaccagaaactggagatgcaaccccacctggtgctggggcatcggcaccggctgcacctgctgcggcatggacgtggagagatacttcaacaagtacttcggcgtgaagtgggccctggagtacgtgagaaccgacgtggtggtgtgcgtggagctgaccaacgaggagagacactgcgacctggtgcaggccggcagcagattcagcatcggccccgtgagcgtgaccctgagcgacccccagaacgtggtgaacagactgagcagcagcatcatgaccatccaggagatcagcgacaacggcatcctggacgtgatgcacgtgagcaaggtgatcagcgccgagaacgcctgcaagctgcagagctgcacccacggcagccccggcgacctgcagatcctgcacaccgacaacctgatcaagggcgagatgagcagcggcatcaacctggcccacctggacccccaggtgaacaccagctggatgagctgggagggctgcgacctggactacttctgcaccgtgggcgactggcccagctgcacctacaccggcgtgaacagcatcaacaccgacagcttcaccaacctgatcaacaccgagaccgactacaccagcaagttccacttccacagcaagagaatcagcgccagaggcgacaccctgcagatggacctgaaggccagacccaacgtgggcggcggcgagatgaccgtgctggtggaggtgaacggcctggagctgcacagcaagaagatcagcctgaagggcctgaagctgagcaacctgaagtgcagcggctgcttcgcctgcagccccggcctgagctgcaccgtgatcgccagactggagagccccgacgagttcaccatccacctgagaagcaccagcagagacgtggtggtggccgagaccagcgtgaccgccagaaaggccgagaccggcgccaagagcagcttcagagccttcgccgtgaaggacgtgaaggagatctgcctggaggtggtggagaaggagtactgccccagctgcagcatcgaggacctgaagatctgcatcagcgtgaccctggagccccccaaggacatcctgatcgagcacaagggcaccatcgtgcagcactacaacaagagctgcgacgagggctacaactgctggatcggcagcgtgagcggcttcttcgtgggcgtgaaggacttcttcgagaagaacttcggcagcgtgatcatcggcatcgtgagcaccgtgctgcccctgatcctgaccgtgctgttcttcgtgtacggcagaagactgttctgcctgtgcagactgtgccacaagaagtgctgcagaggcagcagcagaggcagagacggctacagcagactgagccaggaggaggagatcaaggagatcatcaagaagttcaacagaaacggcgagctgctgggcagaggcgagaacgacaagagaaccgtggccagaatgttcatggacagccagagcgccagaaaggccgtgaaggaggtggcctga

SEQ ID NO: 9213 - RNA, 4302 nt, synthetic construct
  misc_feature 1..4302: note = derived and/or modified CDS sequence (opt4) from BUNV__NC_001926.1__GP
  source 1..4302: mol_type = other RNA
atgagaatcctgatcctgctgctggccgtgacccagctggccgtgagcagccccgtgatcaccagatgcttccacggcggccagctgatcgccgagagaaagagccagaccagcatcagcgagttctgcatcaaggacgacgtgagcatgctgaagagcgagatcgtgtacaccaagaacgacaccggcatcttcggccacagcaaggtgttcagacactggaccatcaccgactggaaggcctgcaaccccgtggtgaccgccggcggcagcatcaacgtgatcgaggtggacaagaacctgaacctggtgaccagaaactacgtgtgcaccggcgactgcaccatcaccgtggacagaaagaacgcccagatcatcttccagaccgacaagctgaaccacttcgaggtgaccggcaccaccatcagcaccggctggttcaagagcaaggccagcgtgaccctggacagaacctgcgagcacatcaaggtgagctgcggcaagaagaccctgcagttccacgcctgcttcaagcagcacatgagctgcgtgagattcctgcacagaagcatcctgcccggcagcatggccatcagcatctgccagaacatcgagctgatcatcatcaccatcctggccctgtgcatcttcatcatcatgatcatcctgaccaagacctacatctgctacgtgctgatccccgtgttcatgcccatcgccttcgcctacggctgggcctacaacagaagctgcaagaagtgcacctgctgcggcctggcctaccaccccttcaccaactgcggcagctactgcgtgtgcggcagcaagttcgagaccagcgacagaatgagaatgcacagagagagcggcctgtgccagggcttcaagagcctgagagtggccagaagactgtgcaagagcaagggcagcagcctgatcatcagcatcctgctgagcgtgctgatcctgagcttcgtgacccccatcgagggcaccctgaccaactaccccaccgaccagaagtacaccctggacgagatcgccgacgtgctgcaggccaagacccacgaggacagcaccaagtactacatcatcctgtacaccagcctgttcggcgccggcctgaccatcatcttcgccggcgtggccctgggcctgaccatcatcctggaggtgctgaccaagatcaacgtgatcttctgcaacgagtgcaacatgtaccacagcaagaagagcatcaagtacgtgggcgacttcaccaacaagtgcggcttctgcacctgcggcctgctggaggaccccgagggcgtggtggtgcacaaggccaagaagagctgcacctacagctaccagatcaactgggtgagaggcatcatgatcttcgtggccttcctgttcgtgatccagaacaccatcatcatggtggccgccgaggaggactgctggaagaacgaggagctgaaggaggactgcgtgggccccctgatcgcccccaaggactgcaccgacaaggaccacaagacctacctgagcgaggccagcctgctggccaccgccaagaagatcacccaggtggacgccgagaacgtggagatcctgggcaagaccatggagagcgccatcagagtgatcgagagacagaagacctaccacagaatgcacctgctggaggccgtgttcctgaacaagcactgcgactactacaagatgttcgagcacaacagcggctacagccaggtgaagtggagaatgatgatcaagacccagcacttcgacatctgcgccctgcaggccaacagccccttctgcgcccagtgcatcgccgacaacagctgcgcccagggcagctgggagttcgacacccacatgaacagcacctacagcagcaaggtggacaacttcaagcacgacttcagcctgttcctgagaatcttcgaggccgccttccccggcaccgcctacgtgcacctgctgaccaacatcaaggagaagaagccctaccaggccgtgagcatgatcgagaagatcaagaagaagttccccaacaacaagctgctgatcggctacctggacttcggcaagtacctgctgggcctgagccacgccagcacctacgagctgcagcagagacagctggacaagctgtaccagcccaccgagctgaccagaagcggcggccagcagaccagcctggccaacagcgtggtgggccaggccaccaaggagtgcaagaagtacaaggacgtgagctgcctgagccccagattcggcatccccctggaggacctgatcagctgctgcgaccagcccaactacaacatctacaagaagcccaagaaggtgtacaaggcccacgacaaggaggagacctggtgcatcaacgaccagcactgcctggtggacttcgtgcccgccgaggccgacaccgtggagaagctgaagcccatgaagtgctggctggtggaccccggcaagaacgacgacgtgtacagcatcgccatcaagacctgcagagtggtggacaagggcgtgtgcaccgtgaacagccagaagtggaacatcatcaagtgcgacagcggccccctgtactacagcgaccacatccccggcgaggacaccggcaacgacatcggccactactgcgtgagcgccggctgcaagaccgacagataccccatcaaccccgacgtggtgaccgactgcgtgtgggagttcaccagcagaaagagccagtacatcggcaagatcagcatgcagagcctggaggactacgagaaggccctgaccgacagactgacccacaccctggagacctacagcttcgcccccctggagaacctgccccacatcaagcccgtgtacaagtacatcaccgcccagggcgtggagaacagcgacggcatcgagggcgccttcatcaccgccagcatccccgccgccggcggcaccagcatcggctacaacgtgagaagcaaggacggcttccccctgctggacctgatcgtgttcgtgaagagcgccgtgatcaagagcacctacaaccacatctacgacaccggccccaccatcagcatcaacaccaagcacgacgagcactgcaccggccagtgccccagcaacatcgagcacgaggccaactggctgaccttcagccaggagagaaccagcagatggggctgcgaggagttcggctgcctggccgtgaacaccggctgcgtgttcggcagctgccaggacgtgatcagacccgagaccaaggtgtacagaaaggccgtggacgaggtggtgatcctgaccgtgtgcatcacctaccccggccacaccttctgcaccgagatcaacgccatcgagcccaagatcaccgaggagatcgagctgcagttcaagaccgtggacaccaagaccctgccctacatcgtggccgtgaacaaccacaagctgtacagcggccagatcaacgacctgggcaccttcggccagatgtgcggcaacgtgcagaagaccaacagcagcatcctgggcaccggcacccccaagttcgactacacctgccacggcgccagcagaaaggacatcatcgtgagaagatgctacaacaacaacttcgacagctgcaagctgctgaaggaggagacccagctgatcttcaacgacgaccacgacaccatcaccgtgtacaacaccaaccacctgatcggcgagctggccatcaagctgatcctgggcgacatccagtacaagctgttcaccgagaccctggacctgcagatcgacgccaagtgcgtgggctgccccgactgcttcgagagctacagctgcaacttccagatcgtgagcaacatcgacaccatctgcagcctggagggcccctgcgacaccttccacaacagaatcagcatcaaggccatgcagcagaactacgccgtgaagctgagctgccagaaggaccccagacccagcggcaccttcaagatctgcaacagagagtacaccgtggtgttccacaccgtggccaaggacgacaagatcgagatcaacgtgggcgaccagaccagcttcatcaaggagaaggacgacagatgcaagacctggctgtgcagagtgagagacgagggcatcagcgtgatcttcgagcccatcaaggccttcttcggcagctacttcagcatcttcttctacatcatcgtggtggtggtggtgggcttcctgatcatctacatcttcatgcccatgttcatgaagctgaaggaggtgctgaaggccaacgagaagctgtacctgcaggagatcaagcagaagtga

SEQ ID NO: 9214 - RNA, 4311 nt, synthetic construct
  misc_feature 1..4311: note = derived and/or modified CDS sequence (opt4) from BUNV(SFCrEq231)__KP063893.1__GP
  source 1..4311: mol_type = other RNA
atgaagatgatcctgctgatcatcatcctgtgcgtgaacctggccgccgccaaccccgtggccaccagatgcttccacggcggccagctgatcgccgagaccagaagcgccaccagcatcagcgagttctgcctgaaggacgacgtgagcatgatcaagagcgagatcacctacaccaagaacgacaccggcatcttcggccacagcaagatctacaagagctggctgatcaaggactggaagctgtgcaaccccgtgcccaccgccggcggcagcatcaacgtgatcgaggtgaacagcgacctgagcctgaccaccaaggcctacgtgtgcagcagagactgcaccatcaccatcgacaaggaggaggcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcagacaccacatgagctgcgtgagattcttccacaacaccatcctgcccggcaccatggtgaacagcatgtgccagaacatcgagctgatcatcatcctgggcctgaccctgatcatcttcaccctgatggtgatcctgaccaagacctacatctgctacatcctgatgcccctgttcatgcccatcgcctacgcctacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctgatcatcagcaccctgctgagcatgctgctgctgagcttcatcacccccatcgagggcaccatgaccaactaccccgagaccagacagtacagcctggaggagatcgccgacgtggtggagggcctgctgagcgagcagaacatcaaggagtacgtggtgttctacaccagcctgttcggcagcctgatcctgctgctggccttcatcctgagcatcaccctgaccaaggtgaccaacgccctggccagaaccaacgtgatctactgcgaggagtgcagcatgtaccacgccaagaagggcatcaagtacaacggcgacttcaccaacaagtgcggcttctgcacctgcgacgagcaggaggacgaggagggcatcatcatccacaaggtgagcaagaagtgcacctacagataccagctgcagtgggccaagatcatcatgatcatcctggtgatgctgctgatgatgcagaacaccatcctgatcgtggccgccgagaccgactgctggaccaagaacagcctggagctggactgcatcggccccctgctgaccatcagcgactgcagcaacaaggagagcaagaactacgaggaggaggccgccaagctggtgagccagagcaagatcacccaggccgacgccgagcaggtgaccatcctgggcaacaccatcgacaccgccctgaaggccatcagaagccagaagacctaccagaccatgcacctgctggagagcgtgttcctgatgaagaactgcgactactacagcagcttcgagcccaacagcggctacagccaggccaagtggagactgatcgccaagaccagccacttcgacatctgcagcagacacagcatgcaccacttctgcagatgcgtggccgacggcaccaagtgccagaacggcgactgggacttcgccggcgagatgaacaacatctacagcaccaagaacgacttctacctgcacgacctgaacctgttcttcaccctgcacgagaccgccttccccggcaccaccgagagcctgttctaccagctgatcgccaagaagaacaccaccggcgccagcaagctgctgggcaagctgatcaccaagtacggcaacaacaagctgttcgtgggcatctggaagttcggccagtacctgctgaccctgccctacgtgaacaccaccgagctgagcaagaccagaagagagaccatcctgaagacccaccagatcctgaccagaagccagggcggcagaagcgagagcatgagcagcgccgaggtgggccagatcgccaaggagtgcgccaacgccaagaacgtgggctgcatcagccccagattcggcatccccatcggcaacctgaccgcctgcggcaacagccccaactacaagatctacaagacccccaacaagatctacaagagcaacaacagaggcgaggtgtggtgcagcgaggacgtgcactgcctggccgacttcgagcccgccgacaccgaggtggtgaacaaggtgaagaagatgacctgcttcctgagcgacgtgaacaccagagccgacatcttcagcatcgccatcagcgcctgcagaatggtggacaagggcgtgtgcaccgtgaacggcgccaagtggaacatcctgaagtgcgagagcggcctgtactacttcaccgaccacagagagggccaggacaccggcaacgacttcggcgagtactgcatcagccacagctgcaacaccgagagataccccatcaaccccgacatcctgaaggagtgcatctgggagtaccacagcagaaagagcaagtacatcagcaccatcaacctggagagcctggaggagttcaagagagccatgagcgacaagctgagccacaccctgatggtgtacaacttcaagcccaccgccaacctgccccacatcaagcccagctacaagttcatcaccgccaacggcatcgagaacagcgacggcctggagagcgcctacatcctgagcagcatccccgccatcggcggcatgagcatcggctacaacatccagaccaaggacaacttccccctgctggacctgatcgtgttcgtgaagagcgccgtgatcaagaccacctacaaccacatctacgacaccggccccaccatcggcatcaacaccaaccacgacgagcactgcaccggcccctgccccaccatcatcccccacaaggagaactggctgaccttcagccaggagagaaccagcagatggggctgcgaggagttcggctgcctggccatcaacaccggctgcgtgttcggcagctgccaggacgtgatccaccccgagaccaagatctacagaaaggccgtggaggaggaggtggtgctgaccgtgtgcatcaacttccccggcaacaccttctgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccagagcatcctgggcgccggcaccgtgaagttcgactacgtgtgccacggcgccagcagaaaggacatcatcgtgagaagatgctacaccaacaactacgacagctgcaagctgctgaaggaggagagaagcctgatcttcgccgacaaccacgagaccctggaggtggccaacaccagacacctgatcggcgagctgcagttcaagatcatgctgggcgacatcagatacaaggccttcgccgagaagcccgagctggagatcgacgccaagtgcgtgggctgccccagctgcttcgagagctacagctgcaacttccagatcgtgaccagcatcgacaccgtgtgcagcgtggagggcccctgcaccctgttccacaacagaatcatcatcaccgccgccaagcagagctacggcgtgaagatgagctgcaagaccaagcccggccccgtggaggagttcaccatctgcaacagaaactacagagtgagcttcgccaccatcgacaagaacgacaagatcgagatcaacaccggcgaccagaccagctacatcgtggagaaggacagcagatgcaagacctggctgtgcagagtgagagacgagggcatcagcgtgatcttcgagcccctgaaggccttcttcggcagctacttcagcatcgccttctacatcatcatcggcatcgccgccctgttcctgatcatctacatcttcctgcccatgttcttcaagctgagagacgtgctgaagaagaacgagtacctgtacctgcaggagctgaagcacaagtga

SEQ ID NO: 9215 - RNA, 4302 nt, synthetic construct
  misc_feature 1..4302: note = derived and/or modified CDS sequence (opt4) from BUNV(GSA/S4/11232/WT)__KM507339.1__GP
  source 1..4302: mol_type = other RNA
atgagaatcctgatcctgctgctggccgtgaccaagctggccgtgggcagccccgtggtgaccagatgcttccacggcggccagctgatcgccgagagaaagagccagaccagcatcagcgagttctgcatcaaggacgacgtgagcatgctgaagagcgagatcgtgtacaccaagaacgacaccggcatcttcggccacagcaaggtgttcagacactggaccatcaccgactggaaggcctgcaaccccgtggtgaccgccggcggcagcatcaacgtgatcgaggtggacaagaacctgaacctggtgaccagaaactacgtgtgcaccggcgactgcaccatcaccgtggacaaggagaacgcccagatcatcttccagaccgacagactgaaccacttcgaggtgaccggcaccaccatcagcaccggctggttcaagagcaaggccagcgtgaccctggacagaacctgcgagcacatcaaggtgagctgcggcaagaagaccctgcagttccacgcctgcttcaagcagcacatgagctgcgtgagattcctgcacagaagcatcctgcccggcagcatggccatcagcatctgccagaacatcgagctgatcatcatcaccatcctggccctgtgcatcttcatcatcatgatcatcctgaccaagacctacatctgctacgtgctgatccccgtgttcatgcccatcgccttcgcctacggctgggcctacaacagaagctgcaagaagtgcacctgctgcggcctggcctaccaccccttcaccaactgcggcagctactgcgtgtgcggcagcaagttcgagaccagcgacagaatgagaatgcacagagagagcggcctgtgccagggcttcaagagcctgagagtggccagaagactgtgcaagagcaagggcagcagcctgatcatcagcatcctgctgagcgtgctgatcctgagcttcgtgacccccatcgagggcaccctgaccaactaccccaccgaccagaagtacaccctggacgagatcgccgacgtgctgcaggccaagacccacgaggacagcaccaagtactacatcatcctgtacaccagcctgttcggcgccggcctgaccatcatcttcgccggcgtggccctgggcctgaccatcatcctggaggtgctgaccaagatcaacgtgatcttctgcaacgagtgcaacatgtaccacagcaagaagagcatcaagtacgtgggcgacttcaccaacaagtgcggcttctgcacctgcggcctgctggaggaccccgagggcgtggtggtgcacaaggccaagaagagctgcacctacagctaccagatcagctgggtgaagggcatcatgatcttcgtggccttcctgttcgtgatccagaacaccatcatcatggtggccgccgaggaggactgctggaagaacgaggagctgaaggaggactgcgtgggccccctgatcgcccccaaggactgcaccgacaaggacagaaagacctacctgagcgaggccagcctgctggccaccgccaagaagatcacccaggtggacgccgagaacgtggagatcctgggcaagaccatggagagcgccatcagagtgatcgagagacagaagacctaccacagaatgcacctgctggaggccgtgttcctgaacaagcactgcgactactacaagatgttcgagcacaacagcggctacagccaggtgaagtggagaatgatgatcaagacccagcacttcgacatctgcgccctgcaggccagcagccccttctgcgcccagtgcatcgccgacaacagctgcgcccagggcagctgggagttcgacacccacatgaacagcacctacagcagcaaggtggacaacttcaagcacgacttcagcctgttcctgagaatcttcgaggccgccttccccggcaccgcctacgtgcacctgctgaccaacatcaaggagaagaagccctaccaggccgtgagcatgatcgagaagatcaagaagaagttccccaacaacaagctgctgatcggctacctggacttcggcaagtacctgctgggcctgagccacgccagcacctacgagctgcagcagagccagctggacaagctgtaccagcccaccgagctgaccagaagcggcggccagcagaccagcctggccagcagcgtggtgggccaggccaccaaggagtgcaagaagtacaaggacgtgagctgcctgagccccagattcggcatccccctggaggacctgatcagctgcggcgaccagcccaactacaacatctacaagaagcccaagaaggtgtacaaggcccacaacaaggaggagacctggtgcatcaacgaccagcactgcctggtggacttcgtgcccgccgaggccgacaccgtggagaagctgaagcccatgaagtgctggctggtggaccccggcaagaacgacgacgtgtacagcatcgccatcaagacctgcagagtgatcgacaagggcgtgtgcaccgtgaacagccagaagtggaacatcatcaagtgcgacagcgacctgctgtactacagcgaccacgtgcccggcgaggacaccggcaacgacatcggccactactgcgtgagcgccggctgcaagaccgacagataccccatcaaccccgacgtggtgaccgactgcgtgtgggagttcaccagcagaagaagccagtacatcggcaagatcagcatgcagagcctggaggactacaagaaggccctgaccgacagactgacccacaccctggagacctacagcttcgcccccctggagaacctgccccacatcaagcccgtgtacaagtacatcaccgcccagggcgtggagaacagcgacggcatcgagggcgccttcatcaccgccagcatccccgccgccggcggcaccagcatcggctacaacgtgagaagcaaggacggcttccccctgctggacctgatcgtgttcgtgaagagcgccgtgatcaagagcacctacaaccacatctacgacaccggccccaccatcagcatcaacaccaagcacgacgagcactgcaccggccagtgccccagcaacatcgagcacgaggccaactggctgaccttcagccaggagagaaccagcagatggggctgcgaggagttcggctgcctggccgtgaacaccggctgcgtgttcggcagctgccaggacgtgatcagacccgagaccaaggtgtacagaaaggccgtggacgagatcgtgatcctgaccgtgtgcatcacctaccccggccacaccttctgcaccgagatcaacgccatcgagcccaagatcaccgaggagatcgagctgcagttcaagaccgtggacaccaagaccctgccctacatcgtggccgtgaacaaccacaagctgtacagcggccagatcaacgacctgggcaccttcggccagatgtgcggcaacgtgcagaagaccaacagcagcatcctgggcaccggcacccccaagttcgactacacctgccacggcgccagcagaaaggacatcatcgtgagaagatgctacaacaacaacttcgacagctgcaagctgctgaaggaggagacccagctgatcttcaacgacgaccacgacaccatcaccgtgtacaacaccaaccacctgatcggcgagctggccatcaagctgatcctgggcgacatccagtacaagctgttcaccgagaccctggacctgcagatcgacgccaagtgcgtgggctgccccgactgcttcgagagctacagctgcaacttccagatcgtgagcaacatcgacaccatctgcaacctggagggcccctgcgacaccttccacaacagaatcagcatcaaggccatgcagcagaactacgccgtgaagctgagctgccagaaggaccccggccccagcggcaccttcaagatctgcaacagagagtacaccgtggtgttccacaccgtggccaaggacgacaagatcgagatcaacgtgggcgaccagaccagcttcatcaaggagaaggacgacagatgcaagacctggctgtgcagagtgagagacgagggcatcagcgtgatcttcgagcccatcaaggccttcttcggcagctacttcagcatcttcttctacatcatcatcatcgtggtggtgggcttcctgatcatctacatcttcatgcccatgttcatgaagctgaaggaggtgctgaaggccaacgagaagctgtacctgcaggagatcaagcagaagtga

SEQ ID NO: 9216 - RNA, 4302 nt, synthetic construct
  misc_feature 1..4302: note = derived and/or modified CDS sequence (opt4) from BUNV(MGD/S1/12060/WT)__KM507340.1__GP
  source 1..4302: mol_type = other RNA
atgagaatcctgatcctgctgctggccgtgaccaagctggccgtgggcagccccgtggtgaccagatgcttccacggcggccagctgatcgccgagagaaagagccagaccagcatcagcgagttctgcatcaaggacgacgtgagcatgctgaagagcgagatcgtgtacaccaagaacgacaccggcatcttcggccacagcaaggtgttcagacactggaccatcaccgactggaaggcctgcaaccccgtggtgaccgccggcggcagcatcaacgtgatcgaggtggacaagaacctgaacctggtgaccagaaactacgtgtgcaccggcgactgcaccatcaccgtggacaaggagaacgcccagatcatcttccagaccgacagactgaaccacttcgaggtgaccggcaccaccatcagcaccggctggttcaagagcaaggccagcgtgaccctggacagaacctgcgagcacatcaaggtgagctgcggcaagaagaccctgcagttccacgcctgcttcaagcagcacatgagctgcgtgagattcctgcacagaagcatcctgcccggcagcatggccatcagcatctgccagaacatcgagctgatcatcatcaccatcctggccctgtgcatcttcatcatcatgatcatcctgaccaagacctacatctgctacgtgctgatccccgtgttcatgcccatcgccttcgcctacggctgggcctacaacagaagctgcaagaagtgcacctgctgcggcctggcctaccaccccttcaccaactgcggcagctactgcgtgtgcggcagcaagttcgagaccagcgacagaatgagaatgcacagagagagcggcctgtgccagggcttcaagagcctgagagtggccagaagactgtgcaagagcaagggcagcagcctgatcatcagcatcctgctgagcgtgctgatcctgagcttcgtgacccccatcgagggcaccctgaccaactaccccaccgaccagaagtacaccctggacgagatcgccgacgtgctgcaggccaagacccacgaggacagcaccaagtactacatcatcctgtacaccagcctgttcggcgccggcctgaccatcatcttcgccggcgtggccctgggcctgaccatcatcctggaggtgctgaccaagatcaacgtgatcttctgcaacgagtgcaacatgtaccacagcaagaagagcatcaagtacgtgggcgacttcaccaacaagtgcggcttctgcacctgcggcctgctggaggaccccgagggcgtggtggtgcacaaggccaagaagagctgcacctacagctaccagatcagctgggtgaagggcatcatgatcttcgtggccttcctgttcgtgatccagaacaccatcatcatggtggccgccgaggaggactgctgggagaacgaggagctgaaggaggactgcgtgggccccctgatcgcccccaaggactgcaccgacaaggacagaaagacctacctgagcgaggccagcctgctggccaccgccaagaagatcacccaggtggacgccgagaacgtggagatcctgggcaagaccatggagagcgccatcagagtgatcgagagacagaagacctaccacagaatgcacctgctggaggccgtgttcctgaacaagcactgcgactactacaagatgttcgagcacaacagcggctacagccaggtgaagtggagaatgatgatcaagacccagcacttcgacatctgcgccctgcaggccagcagccccttctgcgcccagtgcatcgccgacaacagctgcgcccagggcagctgggagttcgacacccacatgaacagcacctacagcagcaaggtggacaacttcaagcacgacttcagcctgttcctgagaatcttcgaggccgccttccccggcaccgcctacgtgcacctgctgaccaacatcaaggagaagaagccctaccaggccgtgagcatgatcgagaagatcaagaagaagttccccaacaacaagctgctgatcggctacctggacttcggcaagtacctgctgggcctgagccacgccagcacctacgagctgcagcagagccagctggacaagctgtaccagcccaccgagctgaccagaagcggcggccagcagaccagcctggccagcagcgtggtgggccaggccaccaaggagtgcaagaagtacaaggacgtgagctgcctgagccccagattcggcatccccctggaggacctgatcagctgcggcgaccagcccaactacaacatctacaagaagcccaagaaggtgtacaaggcccacaacaaggaggagacctggtgcatcaacgaccagcactgcctggtggacttcgtgcccgccgaggccgacaccgtggagaagctgaagcccatgaagtgctggctggtggaccccggcaagaacgacgacgtgtacagcatcgccatcaagacctgcagagtgatcgacaagggcgtgtgcaccgtgaacagccagaagtggaacatcatcaagtgcgacagcgacctgctgtactacagcgaccacgtgcccggcgaggacaccggcaacgacatcggccactactgcgtgagcgccggctgcaagaccgacagataccccatcaaccccgacgtggtgaccgactgcgtgtgggagttcaccagcagaagaagccagtacatcggcaagatcagcatgcagagcctggaggactacaagaaggccctgaccgacagactgacccacaccctggagacctacagcttcgcccccctggagaacctgccccacatcaagcccgtgtacaagtacatcaccgcccagggcgtggagaacagcgacggcatcgagggcgccttcatcaccgccagcatccccgccgccggcggcaccagcatcggctacaacgtgagaagcaaggacggcttccccctgctggacctgatcgtgttcgtgaagagcgccgtgatcaagagcacctacaaccacatctacgacaccggccccaccatcagcatcaacaccaagcacgacgagcactgcaccggccagtgccccagcaacatcgagcacgaggccaactggctgaccttcagccaggagagaaccagcagatggggctgcgaggagttcggctgcctggccgtgaacaccggctgcgtgttcggcagctgccaggacgtgatcagacccgagaccaaggtgtacagaaaggccgtggacgagatcgtgatcctgaccgtgtgcatcacctaccccggccacaccttctgcaccgagatcaacgccatcgagcccaagatcaccgaggagatcgagctgcagttcaagaccgtggacaccaagaccctgccctacatcgtggccgtgaacaaccacaagctgtacagcggccagatcaacgacctgggcaccttcggccagatgtgcggcaacgtgcagaagaccaacagcagcatcctgggcaccggcacccccaagttcgactacacctgccacggcgccagcagaaaggacatcatcgtgagaagatgctacaacaacaacttcgacagctgcaagctgctgaaggaggagacccagctgatcttcaacgacgaccacgacaccatcaccgtgtacaacaccaaccacctgatcggcgagctggccatcaagctgatcctgggcgacatccagtacaagctgttcaccgagaccctggacctgcagatcgacgccaagtgcgtgggctgccccgactgcttcgagagctacagctgcaacttccagatcgtgagcaacatcgacaccatctgcaacctggagggcccctgcgacaccttccacaacagaatcagcatcaaggccatgcagcagaactacgccgtgaagctgagctgccagaaggaccccggccccagcggcaccttcaagatctgcaacagagagtacaccgtggtgttccacaccgtggccaaggacgacaagatcgagatcaacgtgggcgaccagaccagcttcatcaaggagaaggacgacagatgcaagacctggctgtgcagagtgagagacgagggcatcagcgtgatcttcgagcccatcaaggccttcttcggcagctacttcagcatcttcttctacatcatcatcatcgtggtggtgggcttcctgatcatctacatcttcatgcccatgttcatgaagctgaaggaggtgctgaaggccaacgagaagctgtacctgcaggagatcaagcagaagtga

SEQ ID NO: 9217 - RNA, 4308 nt, synthetic construct
  misc_feature 1..4308: note = derived and/or modified CDS sequence (opt4) from Ab-BUNV(Cu20-XJ)__KJ710423.1__GP
  source 1..4308: mol_type = other RNA
atggccatcagcatcgtgctgatgatcatcttcagcaccaccagctgcctggccagagccgcccccagcatcagcaagtgcttccaggacggcgtgctgatcgccgagaagaagagcagcagcggcatcagcgagttctgcatcaaggacgacatcagcatcctgaagagcgagatcaactacagcaagaacgacaccggcatcttcatgcacagcaaggtgttcagacactggaccgtggccgactggaagcagtgccagcccatccccagcgccggcggcagcatcaacgtgctggaggtggacaagaacctgaacctggtggccaagaactacatgtgcaccagaccctgcgtgatcaccatcgacaaggagaacgcccagctgctgttccagaccgagcagctgaaccagttcgaggtgaccggcaccaccatcagcaccggctggttcaagagcaagaccagcgtgagcctggacaacacctgcgagcacatcaaggtgacctgcggcaagaagagcctgcagttccacgcctgcttcaagcagcacatgagctgcgtgagattcctgcacagaagcgtgctgcccggctacatggccaacagcatctgccagaacatcgagctgatcatcatcatcaccctgaccctggccatcttcatcttcatgtgcatcatcaccagaacctacatctgctacatcatgctgcccctgttcgcccccatcgcctacatctacggctggctgtacaacagaagctgcaagaagtgcatctgctgcggcctggcctaccaccccttcaccaactgcggcagctactgcgtgtgcggcagcagattcgagaccagcgacagaatgagactgcacagagagagcggcctgtgccagggcttcaagagcctgagagtggccagaaccctgtgcaagagcaagggcagcagcctggtgatcagcgtgctgaccgccatgctgatcctgagcttcgtgacccccctggaggccatcagcaccaactaccccaccgacagaaagtacaccctgaacgaggtgaacgacatcgtgctgggcaagggcaccgagaacgagctgaagaccagcatcctggccctggtgagcatctgcggcatcggcatcatcatcatcttcatcgccctgaccatgctgctggacatcgtgctggaggccatcgccaagagaagcaccatcttctgcaccgagtgcaacctgatccacgacaagaaggccatgaagttcgtgggcgacttcaccaacaagtgcggcttctgcccctgcggcgagctggaggaccccgagggcctggtgatccacaccaccagaaagagctgcacctactacatcaagatcagaaacctgaagctgatcatgctggtgttcagcatcgccatcctgatgcagaacaccgccatgctggtggtggccgacgagaactgctggaccaacaccgagatcaaggccgactgcgtgggccccctgatcggccccaccacctgcaccaacaagggcagcaagacctacaaggccgtggcccaggagctggtgaccagcaacaagatcacccagctggacgccgacaagtacaccctgctgggcgacaccatcgagagcgccctgagcgccatcaccgagcagaagcactacagcgccatccacctgctggagaccatcttcctgatgaagcactgcgactactacaaggtgtacgagcacaacagcggctacagccagaccaagtggagactgatcgccaagaccaacagcttcgacatctgcagcatccccagcacccccaacttctgcaagtgcctgagcgacagcagctgcagcaccagcaccctgaacttcgccaccagcatgaacagcacctacaccagcaaggccgagtacttcaaccacgacttcaccctgttcctgaacatcttcgaggccgccttccccggcagcgccaccgccttcctgttcaagaagatcaaggagaaggccccctaccaggccttcgagatgatgggcaagatcgccaacaagtaccccaacaacaagctgctggtggtgctgctgaagtacggccagtacatggtgggcctgagccacgccagcacctaccagctgaagcaggagtggatcgccaagagcctgagcctggtgagaagcaccaagaccggcctgaagatggccatgaccaacgccgagcccggccccgccaccaaggagtgcagcgacgccaagaccatcgcctgcctgacccccaagttccaggtggaggtgaacaacctgatgagctgcggcgccagccccaacttcaagatctacatgaagagcggcgagctgtacaaggcccacgacagaaacagcgtgtggtgcctgaacgacatgcactgcctgaccccctacacccccgccaacgccgagctggtggccaccatgaagaagatggagtgctggcaggacaaccccaagcagcccaccaacgactacgccacccccagaagaagctgccagatgaaggacagaggcctgtgcaacgtgggcgccgacaagtggaaggtgatcaagtgcgacgacgacctgatgttctacaccgacgccctggagagccccgaccccgccgccgacatcggccagtactgcttcagcgagaagtgccagatcgagagataccccatcaaccccaccagcctgaccaactgcgagtggctgtacagagccgtgaagccccagtacatcaagagactgagcctgcagaccatcgaggagtacaagaaggccatcaccgacaagctgacccacaccctgcagctgtaccacttcgcccccctggagaacctgccccacatcagacccacctacgagtacatcaccgcccagggcacctacaccgccgacggcatcgagggcgccagcatcatcaccagcatccccgccctgagcggcaccagcgtgggcttcaagatcaacgccaaggacggcaccgccctgctggacatcgtggtgtacatcaagagcagcgtggtgaagagcgtgtacaaccacatctacgacaccggccccaccatcaacatcaacagcaagcacgacgagctgtgcaccggccagtgccccaagagaatccccgccgaccccaactggctgaccttcagccaggagagaaccagcagatggggctgcgaggagttcggctgcctggccatcaacaccggctgcgtgtacggcagctgccaggacgtgatcagaaccgagaccaaggtgtacagaaaggccaacgaggagaccgtgatgctgaccgtgtgcatcacctaccccggccacaccttctgcaccgacgtgaacgccctggagcccaagatcaccgacgagctggagctgcagttcaagaccatcgacatcaagagcctgcccaacctggtggccatcaccaaccacaagctgtacaccggccagatcaacgacctgggcaccttcggccagatgtgcggcaacgtgcagaagaccaacaccagcatcctgggcgccggcacccccaagttcgactacacctgctacagcgccagcagaaaggacatcatcatcagaagatgctacaacaacaactacgacagctgcagactgctgaagcaggagggcgacctgctgttcgacgacaaccacgagaccctgatcgtgtacaacaacaagagactgaacggcgagctgaccatgaagctgctgctgggcgacatccagtacaagctgtacaccgagaacatggagctggagctggaggccaagtgcgtgggctgcgtgggctgcttcgagagctaccagtgcaacctgcagatcaccagcagcctggacggcaactgcgccatcagcggcccctgcgagaccttccacgacagaatccagatcaagaccaccaagaaggactacgccctgaagctggcctgcaccaaggaccccggcgacaaggccaccttcagagtgtgcggcaaggactacgacttcaacttccacaccgtggtgaagaacgacaagatcgaggtgaacgtgggcgacgagaccagctacatcaaggagaaggacgccagatgcggcacctggctgtgcagagtgagagacgagggcctgagcgtgatcttcgagcccctgaagaacttcttcggcaactacctgaacatgttcctgtacatcctgggcggcgtgctgctgctgttcctgagcctgtacatcatcatgcccgtgtgcgccagactgagagacgagctgaagaagaacgagaagctgcaccagatggagatgaagaagagatga

SEQ ID NO: 9218 - RNA, 4305 nt, synthetic construct
  misc_feature 1..4305: note = derived and/or modified CDS sequence (opt4) from ANADV(EIV-13128Kam)__KT313718.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcacctacctgaagaacgacaccggcatcttcgcccacagcaaggtgctgagaaactggatcatcaaggactggaagaactgcaaccccgtgcccaccgccggcggcagcatcaacgtgatcgaggtgaacaccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacatcggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacggcgaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaactgggacttcgccggcgagatgaacaccacctaccacagcaagagagacttcttcaagcacgacttcaacctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcaccacccccggcgaggccagcaaggagtgcagaaacgccaagaagatcagctgcatcagccccagattcggcgtgcccatggagaacctgaccgcctgcggcgagagccccaactacaagatctacaagacccccaccagaatctacaagagcaacaacaagggcgagatctggtgcgccggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcagcaccctgaacctggagagcctggaggagttcaagagagccatcagcgagaagctgagccacaccctggtggtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccaagtgcgtgggctgccccagctgcttcagcagctacagctgcaacttcagaatcagcagcagcatcgacaccgtgtgcgccatcgacggcccctgcaccatcttccacaacagactgatcatcagcagcaccaagcaggactacggcatcaagatgagctgcaaggagaagcccaaccccgtggagaagttcaacatctgcaagagaatctacagcgtgctgttcaccaccatcgacaagagcgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcaccatctacatcttcctgcccatggtgttcaagctgaaggacatcctgaagaagaacgagctgctgtacctgcaggagatgaagtacaagtga

SEQ ID NO: 9219 - RNA, 4305 nt, synthetic construct
  misc_feature 1..4305: note = derived and/or modified CDS sequence (opt4) from ANADV(EIV-13130Kam)__KT313721.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcacctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacatcggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacggcgaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaactgggacttcgccggcgagatgaacaccacctaccacagcaagagagacttcttcaagcacgacttcaacctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcaaggagtgcagaaacgccaagaagatcagctgcatcagccccagattcggcgtgcccatggagaacctgaccgcctgcggcgagagccccaactacaagatctacaagacccccaccagaatctacaagagcaacaacaagggcgagatctggtgcgccggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcagcaccctgaacctggagagcctggaggagttcaagagagccatcagcgagaagctgagccacaccctgatcgtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccaagtgcgtgggctgccccagctgcttcagcagctacagctgcaacttcagaatcagcagcagcatcgacaccgtgtgcgccatcgacggcccctgcaccatcttccacaacagactgatcatcagcagcaccaagcaggactacggcatcaagatgagctgcaaggagaagcccaaccccgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcaccatctacatcttcctgcccatggtgttcaagctgaaggacatcctgaagaagaacgagctgctgtacctgcaggagatgaagtacaagtga

SEQ ID NO: 9220 - RNA, 4305 nt, synthetic construct
  misc_feature 1..4305: note = derived and/or modified CDS sequence (opt4) from ANADV(EIV-13395Mg)__KU159765.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcacctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacatcggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacggcgaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaacagagacttcgccggcgagatgaacaccacctaccacagcaagagagacttcttcaagcacgacttcaacctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcaaggagtgcagaaacgccaagaagatcagctgcatcagccccagattcggcgtgcccatggagaacctgaccgcctgcggcgagagccccaactacaagatctacaagacccccaccagaatctacaagagcaacaacaagggcgagatctggtgcgccggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcagcaccctgaacctggagagcctggaggagttcaagagagccatcagcgagaagctgagccacaccctggtggtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccaagtgcgtgggctgccccagctgcttcagcagctacagctgcaacttcagaatcagcagcagcatcgacaccgtgtgcgccatcgacggcccctgcaccatcttccacaacagactgatcatcagcagcaccaagcaggactacggcatcaagatgagctgcaaggagaagcccaaccccgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcaccatctacatcttcctgcccatggtgttcaagctgaaggacatcctgaagaagaacgagctgctgtacctgcaggagatgaagtacaagtga

SEQ ID NO: 9221 - RNA, 4305 nt, synthetic construct
  misc_feature 1..4305: note = derived and/or modified CDS sequence (opt4) from ANADV(EIV-16002Mg)__KT313724.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcacctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacgtgggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacggcgaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaactgggacttcgccggcgagatgaacaccacctaccacagcaagagagacttcttcaagcacgacttcaagctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcagagagtgcagaaacgccaagaagatcagctgcatcagccccagattcggcgtgcccatggagaacctgaccgcctgcggcgagagccccaactacaagatctacaagacccccgccagaatctacaagagcaacaacaagggcgagatctggtgcgccggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcagcaccctgaacctggagagcctggaggagttcaagagagccatcagcgagaagctgagccacaccctggtggtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccaagtgcgtgggctgccccagctgcttcagcagctacagctgcaacttcagaatcagcagcagcatcgacaccgtgtgcgccatcgacggcccctgcaccgtgttccacaacagactgatcatcagcagcaccaagcaggactacggcatcaagatgagctgcaaggagaagcccaaccccgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcaccatctacatcttcctgcccatggtgttcaagctgaaggacatcctgaagaagaacgagctgctgtacctgcaggagatgaagtacaagtga

SEQ ID NO: 9222 - RNA, 4305 nt, synthetic construct
  misc_feature 1..4305: note = derived and/or modified CDS sequence (opt4) from ANADV(EIV-16199Mg)__KT313730.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcacctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacatcggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacgaggaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaactgggacttcgccggcgagatgaacaccacctaccacagcaagagagacttcttcaagcacgacttcaacctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcaaggagtgcagaaacgccaagaagatcagctgcatcagccccagattcggcgtgcccatggagaacctgaccgcctgcggcgagagccccaactacaagatctacaagacccccaccagaatctacaagagcaacaacaagggcgagatctggtgcgccggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcagcaccctgaacctggagagcctggaggagttcaagagagccatcagcgagaagctgagccacaccctgatcgtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccagatgcgtgggctgccccagctgcttcagcagctacagctgcaacttcagaatcagcagcagcatcgacaccgtgtgcgccatcgacggcccctgcaccatcttccacaacagactgatcatcagcagcaccaagcaggactacggcatcaagatgagctgcaaggagaagcccaaccccgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcatcatctacatcttcctgcccatggtgttcaagctgaaggacatcctgaagaagaacgagctgctgtacctgcaggagatgaagtacaagtga

SEQ ID NO: 9223 - RNA, 4305 nt, synthetic construct
  misc_feature 1..4305: note = derived and/or modified CDS sequence (opt4) from ANADV(EIV-16208Mg)__KT313733.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcacctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcagaaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacatcggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctgatctgcctgctgatcgcccagaacgccgtgctgatcgtggccgccaacgacgactgctgggccaagcagagcctggagatcgagtgcgtgggccccctgcagcaggtggacgcctgcgaggacaagagcagcagaagctacaacggcgaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaactgggacttcgccggcgagatgaacaccacctaccacagcaagagagacttcttcaagcacgacttcaagctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcaaggagtgcagaaacgccaagaagatcagctgcatcagccccagattcggcgtgcccatggagaacctgaccgcctgcggcgagagccccaactacaagatctacaagacccccaccagaatctacaagagcaacaacaagggcgagatctggtgcgccggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcaagtacatcagcaccctgaacctggagagcctggaggagttcaagagagccatcagcgagaagctgagccacaccctggtggtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcatcgtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccaagtgcgtgggctgccccagctgcttcagcagctacagctgcaacttcagaatcagcagcagcatcgacaccgtgtgcgccatcgacggcccctgcaccatcttccacaacagactgatcatcagcagcaccaagcaggactacggcatcaagatgagctgcaaggagaagcccaacagcgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcatcatctacatcttcctgcccatggtgttcaagctgaaggacatcctgaagaagaacgagctgctgtacctgcaggagatgaagtacaagtga

SEQ ID NO: 9224 - RNA, 4305 nt, synthetic construct
  misc_feature 1..4305: note = derived and/or modified CDS sequence (opt4) from ANADV(EIV-16356Mg)__KT313736.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcacctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacatcggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacggcgaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaactgggacttcgccggcgagatgaacaccacctaccacagcaagagagacttcttcaagcacgacttcaagctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcaaggagtgcagaaacgccaagaagatcagctgcatcagccccagattcggcgtgcccatggagaacctgaccgcctgcggcgagagccccaactacaagatctacaagacccccaccagaatctacaagagcaacaacaagggcgagatctggtgcgccggcgacgtgcactgcttccaggagttcacccccctgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcagcaccctgaacctggagagcctggaggagttcaagagagccatcagcgagaagctgagccacaccctggtggtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccaagtgcgtgggctgccccagctgcttcagcagctacagctgcaacttcagaatcagcagcagcatcgacaccgtgtgcgccatcgacggcccctgcaccatcttccacaacagactgatcatcagcagcaccaagcaggactacggcatcaagatgagctgcaaggagaagcccaaccccgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcaccatctacatcttcctgcccatggtgttcaagctgaaggacatcctgaagaagaacgagctgctgtacctgcaggagatgaagtacaagtga

SEQ ID NO: 9225 - RNA, 4305 nt, synthetic construct
  misc_feature 1..4305: note = derived and/or modified CDS sequence (opt4) from ANADV(EIV-17769Yak)__KT313739.1__GP
  source 1..4305: mol_type = other RNA
atgttcctgatcctggtgctgctgatccccttctacatcaccgccacccccgtggccaccagatgcttccacggcggccagctgatcgccgagagcaagagcctgaccgccatcagcgagttctgcctgaaggacgacgtgagcaccgtgaagagcgagatcacctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaacctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacgtgggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacggcgaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaacagagacttcgccggcgagatgaacaccacctaccacagcaagagagacttcttcaagcacgacttcaacctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcagagagtgcagaaacgccaagaagatcagctgcatcagccccagattcggcgtgcccatggagaacctgaccgcctgcggcgagagccccaactacaagatctacaagacccccaccagaatctacaagagcaacaacaagggcgagatctggtgcgccggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcagcaccctgaacctggagagcctggaggagttcaagagagccatcagcgagaagctgagccacaccctggtggtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccaagtgcgtgggctgccccagctgcttcagcagctacagctgcaacttcagaatcagcagcagcatcgacaccgtgtgcgccatcgacggcccctgcaccatcttccacaacagactgatcatcagcagcaccaagcaggactacggcatcaagatgagctgcaaggagaagcccaaccccgtggagaagttcaacatctgcaagagagtgtacagcgtgctgttcaccaccatcgacaagaacgacaagatcgagatcgacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcaccatctacatcttcctgcccatggtgttcaagctgaaggacatcctgaagaagaacgagctgctgtacctgcaggagatgaagtacaagtga

SEQ ID NO: 9226 - RNA, 4305 nt, synthetic construct
  misc_feature 1..4305: note = derived and/or modified CDS sequence (opt4) from ANADV(EIV-18098Yak)__KT313742.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcacctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacgtgggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacggcgaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaactgggacttcgccggcgagatgaacaccacctaccacagcaagagagacttcttcaagcacgacttcaacctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcagagagtgcagaaacgccaagaagatcagctgcatcagccccagattcggcgtgcccatggagaacctgaccgcctgcggcgagagccccaactacaagatctacaagacccccgccagaatctacaagagcaacaacaagggcgagatctggtgcgccggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcagcaccctgaacctggagagcctggaggagttcaagagagccatcagcgagaagctgagccacaccctggtggtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccaagtgcgtgggctgccccagctgcttcagcagctacagctgcaacttcagaatcagcagcagcatcgacaccgtgtgcgccatcgacggcccctgcaccgtgttccacaacagactgatcatcagcagcaccaagcaggactacggcatcaagatgagctgcaaggagaagcccaaccccgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcaccatctacatcttcctgcccatggtgttcaagctgaaggacatcctgaagaagaacgagctgctgtacctgcaggagatgaagtacaagtga

SEQ ID NO: 9227 - RNA, 4305 nt, synthetic construct
  misc_feature 1..4305: note = derived and/or modified CDS sequence (opt4) from ANADV(EIV-18136Yak)__KT313745.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcacctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacatcggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacggcgaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaactgggacttcgccggcgagatgaacaccacctaccacagcaagagagacttcttcaagcacgacttcaagctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcaaggagtgcagaaacgccaagaagatcagctgcatcagccccagattcggcgtgcccatggagaacctgaccgcctgcggcgagagccccaactacaagatctacaagacccccaccagaatctacaagagcaacaacaagggcgagatctggtgcgtgggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatgaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcggcaccctgaacctggagagcctggaggagttcaagagagccatcagcgagaagctgagccacaccctggtggtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccagatgcgtgggctgccccagctgcttcagcagctacagctgcaacttcagaatcagcagcagcatcgacaccgtgtgcgccatcgacggcccctgcaccatcttccacaacagactgatcatcagcagcaccaagcaggactacggcatcaagatgagctgcaaggagaagcccaaccccgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcatcatctacatcttcctgcccatggtgttcaagctgaaggacatcctgaagaagaacgagctgctgtacctgcaggagatgaagtacaagtga

SEQ ID NO: 9228 - RNA, 4305 nt, synthetic construct
  misc_feature 1..4305: note = derived and/or modified CDS sequence (opt4) from ANADV(EIV-18146Yak)__KT313748.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcatctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagctgcacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcgtgagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacatcggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacgaggaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaactgggacttcgccggcgagatgaacaccacctaccacagcaagagagacttcttcaagcacgacttcaacctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcaaggagtgcagaaacgccaagaagatcagctgcatcagccccagattcggcgtgcccatggagaacctgaccgcctgcggcgagagccccaactacaagatctacaagacccccaccagaatctacaagagcaacaacaagggcgagatctggtgcgccggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcagcaccctgaacctggagagcctggaggagttcaagagagccatcagcgagaagctgagccacaccctgatcgtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccagatgcgtgggctgccccagctgcttcagcagctacagctgcaacttcagaatcagcagcagcatcgacaccgtgtgcgccatcgacggcccctgcaccatcttccacaacagactgatcatcagcagcaccaagcaggactacggcatcaagatgagctgcaaggagaagcccaaccccgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcatcatctacatcttcctgcccatggtgttcaagctgaaggacatcctgaagaagaacgagctgctgtacctgcaggagatgaagtacaagtga

SEQ ID NO: 9229 - RNA, 4305 nt, synthetic construct
  misc_feature 1..4305: note = derived and/or modified CDS sequence (opt4) from ANADV(EIV-18353Yak)__KT313751.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcatctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacatcggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacgaggaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaactgggacttcgccggcgagatgaacaccacctaccacagcaagagagacttcttcaagcacgacttcaacctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcaaggagtgcagaaacgccaagaagatcagctgcatcagccccagattcggcgtgcccatggagaacctgaccgcctgcggcgagagccccaactacaagatctacaagacccccaccagaatctacaagagcaacaacaagggcgagatctggtgcgccggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcagcaccctgaacctggagagcctggaggagttcaagagagccatcagcgagaagctgagccacaccctgatcgtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccagatgcgtgggctgccccagctgcttcagcagctacagctgcaacttcagaatcagcagcagcatcgacaccgtgtgcgccatcgacggcccctgcaccatcttccacaacagactgatcatcagccccaccaagcaggactacggcatcaagatgagctgcaaggagaagcccaaccccgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcatcatctacatcttcctgcccatggtgttcaagctgaaggacatcctgaagaagaacgagctgctgtacctgcaggagatgaagtacaagtga
